United States Patent 11,602,557 (BUNYAVIRALES VACCINE) - sequence listing, part 6

SEQ ID NO: 8424 - RNA, 3408 nt, Artificial Sequence
  derived and/or modified CDS sequence (opt4) from HTNV(LongquanAa-10-58)__JQ912861.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugccuguuccugcuguucagccuggugcugcugagcgugcugugccccgugagaaagcacaagaagagcuga

SEQ ID NO: 8425 - RNA, 3408 nt, Artificial Sequence
  derived and/or modified CDS sequence (opt4) from HTNV(LongquanAa-10-74)__JQ912864.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucgagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8426 - RNA, 3408 nt, Artificial Sequence
  derived and/or modified CDS sequence (opt4) from HTNV(LongquanAa-10-98)__JQ912866.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcugcuggagcaggugaagaagagcuuccagagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8427 - RNA, 3408 nt, Artificial Sequence
  derived and/or modified CDS sequence (opt4) from HTNV(LongquanAa-11-452)__KC344264.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaucaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcugcuggagcaggugaagaagagcuuccagagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucaucggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8428 - RNA, 3408 nt, Artificial Sequence
  derived and/or modified CDS sequence (opt4) from HTNV(LongquanAa-11-473)__KC344263.1__GP
augggcaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaucugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugcuggagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccaacagcaccgaggccaagcacguguucagccccggcuucuucccccagcugaaccacaccaagugcgacaagaccgccaucccccugaucuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcagaucaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8429 - RNA, 3408 nt, Artificial Sequence
  derived and/or modified CDS sequence (opt4) from HTNV(LongquanAa-11-642)__KC344262.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugcuggagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaucuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8430 - RNA, 3408 nt, Artificial Sequence
  derived and/or modified CDS sequence (opt4) from HTNV(LongquanAa-11-774)__KC344257.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgagaagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8431 - RNA, 3408 nt, Artificial Sequence
  derived and/or modified CDS sequence (opt4) from HTNV(LongquanMf-09-8)__JQ912875.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaacaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8432 - RNA, 3408 nt, Artificial Sequence
  derived and/or modified CDS sequence (opt4) from HTNV(ROKA14-11)__KU207203.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucaccagcaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8433 - RNA, 3408 nt, Artificial Sequence
  derived and/or modified CDS sequence (opt4) from HTNV(US8A15-1)__KU207205.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagcacugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaccgugcugugcguguuccugcuguucagccuggugcugcugagcauccugugccccgugagaaagcacaagaagagcuga

SEQ ID NO: 8434 - RNA, 3408 nt, Artificial Sequence
  derived and/or modified CDS sequence (opt4) from HTNV(Lee)__D00377.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaccagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcgacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccuaccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaaggaguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8435 - RNA, 3384 nt, Artificial Sequence
  derived and/or modified CDS sequence (opt4) from HTNV(M)__U38177.1__GP
auggccagccugguguggcccgugcugacccugagaaacguguacgacaugaagaucgagugcccccacaccgugagcuucggcgagaacagcgugaucggcuacguggagcugccccccgugccccuggccgacaccgcccagauggugcccgagagcagcugcaacauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaagcuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggcgccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8436 - RNA, 3408 nt, Artificial Sequence
  derived and/or modified CDS sequence (opt4) from HTNV(N8)__EF077656.1__GP
augggcaucuggaaguggcuggugauggccagccugguguggcccgccuacacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacaacaccuacugcaagcccacccuguacaugaucgugcccauccacgccugcaacaugaugaagagcugccugaucgcccugggccccuacagagugcaggugaucuacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccggcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugagagccgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguacaucgaccagcugaagcccgugggcagcgccuacaagaucaucaccaucagauacagcagaaaggugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcguggcccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagguggagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8437 - RNA, 3408 nt, Artificial Sequence
  derived and/or modified CDS sequence (opt4) from HTNV(Q32)__DQ371905.1__GP
augggcaucuggaaguggcuggugauggccagccugguguggcccgccuucgcccugagaaacguguacgacaugaagaucgagugcccccacaccgugagcuucggcgagaacagcgugaucggcuacguggagcugccccccaugccccuggccgacaccacccagauggugcccgagagcagcugcagcauggacaaccaccagagccugaacaccaucaccaaguacacccagaucaucuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaacugcaacgacaccgagaacaaggugcagggcuacuacaucugcaucaucggcggcaacagcagccccguguacgugcccacccuggacgacuucagaagcauggaggccuucagcggcaucuucagaagcccccacggcgaggaccacgaccuggccggcgaggagguggccagcuacagcaucgugggccccgccaacgccaaggugccccacagcgccagcagcgacacccugggccugaucgccuacuucggcauccccagcuacagcagccugagcauccugaccagcagcaccgaggccaagcacguguucagccccggccuguucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaucccccugaaccccguguggaacgacaacgcccacggcgugggcagcauccccaugcacaccgaccuggagcuggacuucagccugaccagcagcagcaaguacaccuacagaagaaagcugaccaacccccuggaggagagccaggccaucgaccugcacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugcagcaccuuccugaccagcaucaaggccugcgacaaggccaucugcuacggcgccgagagcgugacccugaucagaggccagaacaccgugaaggugagcggcaagggcggccacagcggcagcagcuucaagugcugccacggcgaggagugcagccagaucggccugcacgccgccgccccccaccuggacaaggugaacggcaucagcgagauggagaacagcaagguguucgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8438 - RNA, 3408 nt, Artificial Sequence
  derived and/or modified CDS sequence (opt4) from HTNV(Bao14)__AB127995.1__GP
augggcauguggaaguggcuggugaucgccagccugguguggcccgcccuggcccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagcaucaacaccaucaccaaguacacccaggugaucuggagaggcaaggccgaccccggccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucaagagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgacgccaagcacguguucagccccggccuguuccccaagcugaaccacaccaacugcgacaagagcgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcgugcugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugagagugagcggcaagggcggccacagcggcagcaccuucaagugcugccacggcgaggacugcagcaagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8439 - RNA, 3408 nt, Artificial Sequence
  derived and/or modified CDS sequence (opt4) from HTNV(HubeiHu02)__JQ665881.1__GP
augggcaucuggaaguggcuggugauggccagccugguguggcccgccuucgcccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccagaucguguggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcagcaccuacaagcuguucgagcaggugaagaagagcuucgagagcaacugcaacgacaccgagaacaaggugcagggccacuacaucugcaucgugggcggcaacagcgcccccaucuacgugcccacccuggacgacuucagaagcauggaggccuucagcggcaucuucaagagcccccacggcgaggaccacgaccuggccggcgaggagguggccagcuacagcaucgugggccccgccaacgccaaggugccccacagcgccagcagcgacacccugagccugaucgccuacagcggcauccccagcuacagcagccugagcauccugaccagccugaccgaggccaagcacguguucagccccggccuguucccccagcugaaccacaccaagugcgacaagaccgccaucccccugaccuggaccggcaugaucgaccugcccggcuacuacgaggccgugcaccccugcaccguguucugcgugcugagcggccccggcgccagcugcgaggccuucagcgagggcggcauccugaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaccccccugaaccccguguggaacgacaacgcccacggcgugggcagcgugcccaugcacaccgaccuggagcuggacuucagccugaccagcagcagcaaguacaccuacagaagaaagcugaccaacccccuggaggagagccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucagcauccuggugaccaaggacaucgacuucgacaaccugggcgagaaccccugcaagaucggccugcagaccagcagcaucgagggcgccuggggcagcggcgugggcuacacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcagcuucaagugcugccacggcgaggacugcagccagaucggccugcacgccgccgccccccaccuggacaaggugaacggcaucagcgagaucgagaacagcaagguguucgacgacggcgccccccagugcggcaucaagugcugguucgugaagagcggcgaguggaucagcggcaucuucaacggcaacuggaucgugcugaucgugcugugcguguuccugcuguucagccuggugcugcugagcauccugugccccgugagaaagcacaagaagagcuga

SEQ ID NO: 8440 - RNA, 3408 nt, Artificial Sequence
  derived and/or modified CDS sequence (opt4) from HTNV(HV004)__JQ083394.1__GP
augggcaucuggaaguggcuggugauggccagccugguguggcccgccuucgcccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccagaucaucuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcagcaccuacaagcuguucgagcaggugaagaagagcuucgagagcaacugcaacgacaccgagaacaaggugcagggcuacuacaucugcaucgugggcggcaacagcgcccccaucuacgugcccacccuggacgacuucagaagcauggaggccuucagcggcaucuucaagagcccccacggcgaggaccacgaccuggccggcgaggagguggccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacaagcugaagagcgugcugagaaagaucaaggaggaguucgagagaaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaccccccugaaccccguguggaacgacaacgcccacggcgugggcagcgugcccaugcacaccgaccuggagcuggacuucagccugaccagcagcagcaaguacaccuacagaagaaagcugaccaacccccuggaggagagccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcagcuucaagugcugccacggcgaggacugcagccagaucggccugcacgccgccgccccccaccuggacaaggugaacggcaucagcgagaucgagaacagcaagguguucgacgacggcgccccccagugcggcaucaagugcugguucgugaagagcggcgaguggaucagcggcaucuucaacggcaacuggaucgugcugaucgugcugugcguguuccugcuguucagccuggugcugcugagcauccugugccccgugagaaagcacaagaagagcuga

SEQ ID NO: 8441 - RNA, 3405 nt, Artificial Sequence
  derived and/or modified CDS sequence (opt4) from HTNV(NC167)__AB027115.2__GP
auguggggccugcuggugguggccggccugaucggccccugcaucagccugagaaacguguacgacaugaagaucgagugcccccacaccgugaacuucggcgagaacagcgugaucggcuacguggagcugccccccgugcccaucgccgacaucacccagauggugcccgagagcagcugcaacauggacaaccaccagagccugagcaccuucaccaaguacacccagcugaucuggagaaagaaggccgagcaggcccaggccagccagaacagcuucgagaccgugagcagagagguggacuucaagggcaccugcguguucaagcacaagaugguggaggagagcuacaagaacagaaagagcaucaucugcuacgaccugagcugcaacaucacccacugcaagcccacccuguacaugaucauccccgugcacgccugcaacaugaugaagagcugccugaucgcccugggccccuucagagugcaggugguguacgagagaaccuacugcaugagcggcauccugaccgagggcagaugcuucgugcccuaccagagcguggugagcaucaucaagcacggcaucuucgacaucgccagcauccacaucaucugcuucuucaucgccguggagggcaacaccuacaagcuguucgaggaggugaagaagagcuucgcccugaacugcaacgacaccgagaacaagauccagggcuacuacaucugcaucaucggcggcaacagcgcccccguguacgcccccagccccgacgacuucagaagcauggaggccuucagcggcaucuucagaagcccccacggcgagaaccacgaccugaacggcggcagaaacgcccccuacagcaucgugggccccaccgacggcaaggugccccacagcagcaagcacuacaacaucgaguucgacagcaucuuccagaaguuccccaccuacagcagcuucagcauccuggccggcagcguggagcccaagcacguguuccagcccggccuguuccccaagcugaaccacaccaagugcaccaagagcgccaucccccugguguggaccggcagaaucgacauccccggcuacuacgaggccgugcacccccugaccguguacugcgagcugagcggccccggcgccagcugcgaggccuucagcgagggcggcaucuucaacaucaccagccccaugugccuggugagcaagcagaacagauucagaagccugagacagcaggugagcuucgugugccagagaguggacauggacaucgugguguacugcaacggccagaagaagaccauccugaccaagacccuggugaucggccagugcaucuacaccaucaccagccuguucagccugcugcccagcguggcccacagcaucgccguggagcugugcgugcccggcuuccacggcugggccaccgccgcccugcugaucaccuucugcuucggcugggugcugauccccgcccugaccuucaucauccugaccauccugaaguucaucgccaacaucuuccacaccagcaaccaggagaacaagcugaaggccgugcugagaaagaucaaggaggaguucgagaagaccaagggcagcauggugugcgacaucugcaaguacgagugcgacaccuacaaggagcugaaggcccacggccugagcugcccccagagccagugccccuacugcuucacccacugcgagcccaccgagagcgccuuccaggcccacuacaaggugugccaggugacccacagauucagagaggagcugaagaagaccgugaccccccagaacuucacccccggcugcuacagaacccugaaccuguucagauacaagagcagaugcuacaucuucaccauguggauccugcugcugguguucgagagcauccugugggccgccagcgccagcgacgugccccugagcaccgacuggaacgacaacgcccacggcgugggcagcgugcccaugcacaccgaccuggagcuggacuucagccugaccagcagcagcaaguacaccuacagaagaaagcugaccaaccccguggacaccagccaggccguggaccugcacaucgagcuggaggagcagaccaucggccuggacgugcacgcccugggccacugguucgacggcagacugaaccugaagaccagcuuccacugcuacggcgccugcaccaaguacgaguaccccuggcacaccgccaagugccacuucgagagagacuuccaguacgagaccagcuggggcugcaacccccccgacugccccggcgugggcaccggcugcaccgccugcggccuguacaucgaccagcugagacccgugggcaacgccuacaagaucaucaccaucagauacagcagaaaggugugcgugcaguucggcgacgagaaccugugcaagaccaucgacaugaacgacugcuucgugagcaagcacgugaaggugugcaucaucggcaccgugagcaaguucagccagggcgacacccugcuguuccugggccccauggagggcggcggcaucaucuucaagcacuggugcaccagcaccugccaguucggcgaccccggcgacaucaugagccccaaggacaagggcuucagcugccccgaguucagcggcagcuucagaaagaagugcaacuucgccaccacccccgccugcgaguacggcggcaacauggugagcggcuacagaaaggugauggccaccaucgacagcuuccaggccuucaacaccagcaccauccacuucaccgacgagagaaucgaguggaaggaccccgacggcaugcugagagaccacaucaacauccuggugaccagagacaucgacuucgacaaccuggccgagaaccccugcaagaucggccugcaggugagcgccaucgagggcgccuggggcagcggcgugggcuucacccugaccugccaggugagccugaccgagugcagcaccuuccugaccagcaucaaggccugcgacaaggccaucugcuacggcgcccagagcgugacccuggugagaggccagaacaccgugaagaucagcggcaagggcggccacagcggcagcgccuucaagugcugccacggcgaggacugcagccagaccggccugcaggccgacgccccccaccuggacaaggugaacggcaucagcgagguggagaacgacaagguguacgacgacggcgcccccgagugcggcaucaagugcugguucgugaagagcggcgaguggguggccggcaucuucagcggcaacuggaucgugcugguggugcugugcaucuuccugaucaucagccugauccugcugagcauccugugccccgugagaaagcacaagaagagcuga

SEQ ID NO: 8442 - RNA, 3408 nt, Artificial Sequence
  derived and/or modified CDS sequence (opt4) from HTNV(WuhanAaJ10)__JQ665882.1__GP
augggcaucuggaaguggcuggugauggccagccugguguggcccgccuucgcccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccagaucaucuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccgcccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaccgugugcuucuucguggccgugaagggcagcaccuacaagcuguucgagcaggccaagaagagcuuccagagcaacugcaacgacaccgagaacaaggugcagggcuacuacaucugcaucgugggcggcagcagcgcccccaucuacgugcccacccuggacgacuucagaagcauggaggccuucagcggccuguucaagagcccccacggcgaggaccacgaccuggccggcgaggagguggccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguucccccagcugaaccacaccaagugcgacaagaccgccaucccccugaccuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccugaucagccugcugcccggcguggcccacagcaucgccguggagcugugcgugcccggcagccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaccccccugaaccccguguggaacgacaacgcccacggcgugggcagcgugcccaugcacaccgaccuggagcuggacuucagccugaccagcagcagcaaguacaccuacagaagaaagcugaccaacccccuggaggagagccaggccaucgaccugcacaucgagaucgaggaccagaccaucggcguggacgugcacgcccugggccacugguucgacggcagacugaaccuggagaccagcuuccacugcuacggcgccugcaccaaguacgaguaccccuggcacaccgccaagugccacuacgagagagacuaccaguacgagaccagcuggggcugcagccccagcgacugccccggcgugggcaccggcugcaccgccugcggccuguaccuggaccagcugaagcccgugggcagcgccuacaagaucaucaccaucagauacagcagaagagugugcgugcagagcggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggacagagacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcagcuucaagugcugccacggcgaggacugcagccagaucggccugcacgccgccgccccccaccuggacaaggugaacggcaucagcgagaucgagaacagcaagguguucgacgacggcgccccccagugcggcaucaagugcuggagcgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8443 - RNA, 3408 nt, Artificial Sequence
  derived and/or modified CDS sequence (opt4) from HTNV(Z5)__EU074224.1__GP
augggcaucuggaaguggcuggugauggccagccugguguggcccgccugcacccugagaaacguguacgacaugaagaucgagugcccccacaccgugagcuucggcgagaacagcgugaucggcuacguggagcugccccccaugccccuggccgacaccgcccagcuggugcccgagagcagcugcaacauggacaaccaccagagcaugaacaccaucaccaaguacacccaggugagcuggagaagcaagguggaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagggcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacgacaccgagaacaaggugcagggcuacuacaucugcaucgugggcggcaacagcgcccccaucugcgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccggcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucgugauccugaccauccugaaguucaucgccaacaucuuccacaccagcaaccagggcaacagacugaagagcgugcugaagaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccaucuggaacgacaacgcccacggcgugggcagcgugcccaugcacaccgaccuggagcuggacuucagccugaccagcagcagcaaguacaccuacagaagaagacugaccaacccccuggaggagacccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaaggugggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggcccugcugagcgugcugugccccgugagaagacacaagaagagcuga

SEQ ID NO: 8444 - RNA, 3408 nt, Artificial Sequence
  derived and/or modified CDS sequence (opt4) from HTNV(ZLS-12)__FJ753399.1__GP
augggcaucuggaaguggcugaucauggccagccugguguggcccgccuacacccugagaaacguguacgacaugagaaucgagugcccccacaccgugagcuucggcgagaacagcgugaucggcuacguggagcugccccccaugccccuggccgacaccagccagauggugcccgagagcagcugcagcauggacaaccaccagagccugaacaccaucaccaaguacacccaggugagcuggagaggcaaggccgaccagagccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcauccugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacgacaccgaggacaaggugcagggcuacuacaucugcaucgccggcggcaacagcgcccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaccgccuacagcggcauccccagcuacagcagccugagcauccugaccagcagcaccgaggccaagcacguguucagccccggcuucuucccccagcugaaccacaccaagugcgacaagaccgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgaggugccccugagccccguguggaacgacaacgcccacggcgugggcagcauccccaugcacaccgaccuggagcuggacuucagccugaccagcagcagcaaguacaccuacagaagaaagcugaccaacccccuggaggagacccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaagagugugcgugcagcugggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucaaguggaaggaccccgacggcaugcugagagaccacaucaacauccuggugaccaaggacaucgacuucgacaaccugggcgagaaccccugcaagaucggccugcagaccagcgccaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagccuguucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8445 - RNA, 3408 nt, Artificial Sequence
  derived and/or modified CDS sequence (opt4) from HTNV(ZLS6-11)__FJ753397.1__GP
augggcaucuggaaguggcugaucauggccagccugguguggcccgccuacacccugagaaacguguacgacaugagaaucgagugcccccacaccgugagcuucggcgagaacagcgugaucggcuacguggagcugccccccaugccccuggccgacaccagccagauggugcccgagagcagcugcagcauggacaaccaccagagccugaacaccaucaccaaguacacccaggugagcuggagaggcaaggccgaccagagccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcauccugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacgacaccgaggacaaggugcagggcuacuacaucugcaucgccggcggcaacagcgcccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaccgccuacagcggcauccccagcuacagcagccugagcauccugaccagcagcaccgaggccaagcacguguucagccccggcuucuucccccagcugaaccacaccaagugcgacaagaccgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgaggugccccugagccccguguggaacgacaacgcccacggcgugggcagcauccccaugcacaccgaccuggagcuggacuucagccugaccagcagcagcaaguacaccuacagaagaaagcugaccaacccccuggaggagacccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcgccaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagccuguucaagugcugccacggcgaggagugcagccagaucggccugcacgccgccgccccccaccuggacaagguggacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8446 - RNA, 3408 nt, Artificial Sequence
  derived and/or modified CDS sequence (opt4) from HTNV__AB030232.1__GP
augggccuguggaaguggcugaucauggccgugcugguguggcccugcuucgcccugagaaacguguacgacaugaagaucgagugcccccacaccgugaacuucggcgagaacagcguggugggcuacguggagcugccccccaugcccaucgccgacaucacccagaugaugcccgagagcagcugcagcauggacaaccaccagagccugaacaccaucaccaaguacacccaggugagcuggagaaagaaggccgacagagcccagagcagccagaccagcuucgagaccgugagcagcgagguggacuucaagggcaccugcgugcugaagcacaagaugguggaggacagcuacagaagcagaaagagcaucaucugcuacgaccugagcugcaacagcaccuucugcaagcccacccuguaccugaucgugcccgugcacgccugcaacaugaugaagagcugccugaucgcccugggccccuacagagugcaggacguguacgagagaaccuacugcaugagcggcgugcugcuggagggcaagugcuucgugcccgacagaagcguggugagcaucaucaagcacggcaucuucgacaucgccagcgugcacaucgugugcuucuucguggccaucaagggcagcaccuacaagauccuggagcaggugaagaagagcuucgagcugaccugcaacgacaccgacaacaagauccagggcuacuacaucugccuggugggcggcaacagcgcccccaucuacgugcccacccuggacgacuucagaagcauggaggccuucgccggcaucuucaagagcccccacggcgaggaccacgaccuggccggcgaggagguggccagcuacagcaucgugggccccgccaacgccaaggugccccacagcgccagcgccgacacccugagccugguggccuucagcggcauccccagcuacagcagcuucagcgugcugaccggcagcaccgacgccagacacguguucagccccggcuucuucccccagcugaaccagaccagaugcgacaagaccgccaucccccugaccuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcgagcagaacagauucagaagcagcgagcagcaggugaacuucgugugccagagaguggacauggacaucgugguguacugcaacggccagaagaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugacccuggugauccugaccauccugaaguucaucgccaacaucuuccacaccagcaaccaggagaacagacugaagagcgugcugaagaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcauccugugggccgccagcgccagcgagacccccagcacccccaucuggaacgacaacgcccacggcgugggcagcauccccaugcacaccgaccuggagcuggacuucagccugaccagcagcagcaaguacaccuacagaagaaagcugaccaacccccuggagaagacccaggccguggaccugcacaucgagcuggccgugcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucaaguacagcagaagagugugcgugcaguucggcgaggagaaccugugcaaggugaucgacaugaacgacugcuucgugagcagacacgugaagaucugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcuucaacaccagcaugaugcacuucaccgacgagagaaucgaguggaaggaccccgacggcaugcugagagaccacaucaacauccuggugaccaaggacaucgacuucgacaaccugggcgacaaccccugcaaggugggccugcagaccagcgccaucgagggcgccuggggcagcggcgugggcuucacccugaccugccaggugagccugaccgagugccccaccuuccugaccagcaucaaggccugcgacaaggccaucugcuacggcgccgagagcaucacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagauggagaacagcaagguguacgacgacggcgcccccgagugcggcaucaagugcugguucgugaagagcggcgaguggaucagcggcaucuucaacggcaacuggaucgugcugaucgugcugugcgccuuccugaucuucagccuggugcugcugagccugcugugccccgugagaaagcacaagaaggccuga

SEQ ID NO: 8447 - RNA, 3408 nt, Artificial Sequence
  derived and/or modified CDS sequence (opt4) from HTNV__AB620032.1__GP
augggcauguggaaguggcuggugaucgccagccugguguggcccgugcuggcccugagaaacguguacgacaugaagaucgagugcccccacaccgugagcuucggcgagaacagcgugaucggcuucguggagcugccccccaugccccuggccgacaccgcccagauggugcccgagagcagcugcagcauggacaaccaccagagcaucaacaccaucaccaaguacacccaggugaccuggagaggcaaggccgaccccggccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccaucaagggcaacaccuacaagcuguucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucaagagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgacgccaagcacguguucagccccggccuguuccccaagcugaaccacaccaacugcgacaagagcgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucgugauccugaccauccugaaguucguggccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcgugcugugggccgccagcgccagcgagaccccccuggcccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacaccgugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8448 - RNA, 3408 nt, Artificial Sequence
  derived and/or modified CDS sequence (opt4) from HTNV__D25532.1__GP
augggcaucuggaaguggcuggugauggccagccugguguggcccgugcugacccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagcagcaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugggcauccugugccccgugagaaagcacaagaagagcuga

SEQ ID NO: 8449 - RNA, 3408 nt, Artificial Sequence
  derived and/or modified CDS sequence (opt4) from HTNV__L08753.1__GP
augggcaucuggaaguggcuggugauggccagccugguguggcccgccuacacccugagaaacguguacgacaugaagaucgagugcccccacaccgugagcuucggcgagaacagcgugaucggcuacguggagcugccccccaucccccuggccgacaccacccagauggugcccgagagcagcugcagcauggacaaccaccagagccugaacaccgugaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucgccugcuacgaccugagcugcaacagcaccuacugcaagcccacccuguacaugaucgugcccauccacgccugcaacaugaugaagagcugccugaucgcccugggcccccacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcagaucaagaagagcuucgagagcaccuacaacgacaccaagaacaagguggagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgugaaggugccccacagcgccagcagcgacacccugagccugaccgccuacagcggcauccccagcuacagcagccugagcauccuggccggcagcgccgaggccaagcacguguucagccccggcuucuucccccagcugaaccacaccaagugcgacaagaccgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaugaccuucaucgugcugaccauccugaaguucaucgccaacaucuuccacaccagcaaccaggagaacaagcugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaucccccuguaccccguguggaacgacaacgcccacggcgugggcagcgugcccaugcacaccgaccuggagcuggacuucagccugaccagcagcagcaaguacaccuacagaagaaagcugaccaacccccuggaggagagccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgacagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgagaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggcuacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcaucaagugcugguucgugaagagcggcgaguggaucagcggcaucuucagcggcaacuggaucgugcugaucgugcugugcguguuccugcuguucagccugauccugcugagcauccugugccccgccagaaagcacaagaagagcuga

SEQ ID NO: 8450 - RNA, 3408 nt, Artificial Sequence
  derived and/or modified CDS sequence (opt4) from HTNV__M14627.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccgugccccuggccgacaccgcccagauggugcccgagagcagcugcaacauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaagcuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucagaugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8451 - RNA, 3408 nt, Artificial Sequence
  derived and/or modified CDS sequence (opt4) from HTNV__EU074672.1__GP
augggcaucuggaaguggcuggugauggccagccugguguggcccgccuucgcccugagaaacguguacgacaugaagaucgagugcccccacaccgugagcuucggcgagaacagcgugaucggcuacguggagcugccccccaugccccuggccgacaccacccagauggugcccgagagcagcugcagcauggacaaccaccagagccugaacaccaucaccaaguacacccagaucaucuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaacugcaacgacaccgagaacaaggugcagggcuacuacaucugcaucaucggcggcaacagcagccccguguacgugcccacccuggacgacuucagaagcauggaggccuucagcggcaucuucagaagcccccacggcgaggaccacgaccuggccggcgaggagguggccagcuacagcaucgugggccccgccaacgccaaggugccccacagcgccagcagcgacacccugggccugaucgccuacagcggcauccccagcuacagcagccugagcauccugaccagcagcaccgaggccaagcacguguucagccccggccuguucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaagggcagcauggugugcgacaucugcaaguacgagugcgagaccuacagagagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaucccccugaaccccguguggaacgacaacgcccacggcgugggcagcauccccaugcacaccgaccuggagcuggacuucagccugaccagcagcagcaaguacaccuacagaagaaagcugaccaacccccuggaggagagccaggccaucgaccugcacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugcagcaccuuccugaccagcaucaaggccugcgacaaggccaucugcuacggcgccgagagcgugacccugaccagaggccagaacaccgugaaggugagcggcaagggcggccacagcggcagcagcuucaagugcugccacggcgaggagugcagccagaucggccugcacgccgccgccccccaccuggacaaggugaacggcaucagcgagauggagaacagcaagguguucgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8452 - RNA, 3408 nt, Artificial Sequence
  derived and/or modified CDS sequence (opt4) from HTNV__GQ120966.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucccccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8453 - RNA, 3408 nt, Artificial Sequence
  derived and/or modified CDS sequence (opt4) from HTNV(CGAa1011)__EF990927.1__GP
auggagaucuggaaguggcuggugauggccagccugguguggcccgcccuggcccugagaaacgugcacgacaugaagaucgagugcccccacaccgugagcuucggcaagaacagcgugaucggcuacguggagcugccccccaugccccuggccgacaccauccagauggugcccgagagcagcugcagcauggacaaccaccagagccugagcaccgugaccaaguacacccaggugagcuggagaggcaaggccgaccaggcccagagcaaccagaccagcuucgagaccgugagcguggagguggaccugaagggcaccugcgugcugaagcacaagcugguggaggagagcuacagaagcagaaagagccugaccugcuacgaccugagcugcaacagcaccuacugcaagcccacccuguacaugaucgugcccauccacgccugcaacaugaugaagagcugcaucaucgcccugggcccccacagagugcaggugguguacgagagaaccuacugcaugaccggcgugcugcuggagggcaagugcuucgugcccgaccagagcguggugggcaucgugaagcacggcaucuucgacaucgccagcgugcacaucgccugcuucuucguggccaucaccggcaacaccuacaagcuguucgagcaggugaagaagagcuucggcaccaccugcaacgacaccgagaacaaggugcagggcuacuacaucugcauccugggcggcaacagcccccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcugaucaccuucugcuucggcugggugcugauccccgcccugaccuucaucgugcugaccgugcugaaguucaucgccaacaucuuccacaccagcaaccaggagaacagacugaagauggugcugaagaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgagagcgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugagccccaccuggaacgacaacgcccacggcgugggcagcauccccaugcacaccgaccuggagcuggacuucagccugaccagcagcagcaaguacaccuacagaagaaagcugaccaacccccuggaggagagccaggccgugaacuuccacguggagaucgaggagcaggccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcagcaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8454 - RNA, 3408 nt, Artificial Sequence
  derived and/or modified CDS sequence (opt4) from HTNV(CGAa2)__EU092223.1__GP
auggagaucuggaaguggcuggugauggccagccugguguggcccgcccuggcccugagaaacgugcacgacaugaagaucgagugcccccacaccgugagcuucggcaagaacagcgugaucggcuacguggagcugccccccaugccccuggccgacaccauccagauggugcccgagagcagcugcagcauggacaaccaccagagccugagcaccgugaccaaguacacccaggugagcuggagaggcaaggccgaccaggcccagcccagccagaccagcuucgagaccgugagcguggagguggaccugaagggcaccugcgugcugaagcacaagcugguggaggagagcuacagaagcagaaagagccugaccugcuacgaccugagcugcaacagcaccuacugcaagcccacccuguacaugaucgugcccauccacgccugcaacaugaugaagagcugcaucaucgcccugggcccccacagagugcaggugguguacgagagaaccuacugcaugaccggcgugcugcuggagggcaagugcuucgugcccgaccagagcguggugagcaucgugagacacggcaucuucgacaucgccagcgugcacaucgccugcuucuucguggccaucaccggcaacaccuacaagcuguucgagcaggugaagaagagcuucggcaccaccugcaacgacaccgagaacaaggugcagggcuacuacaucugcauccugggcggcaacagcccccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcugaucaccuucugcuucggcugggugcugauccccgcccugaccuucaucgugcugaccgugcugaaguucaucgccaacaucuuccacaccagcaaccaggagaacagacugaagauggugcugaagaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgagagcgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugagccccaccuggaacgacaacgcccacggcgugggcagcauccccaugcacaccgaccuggagcuggacuucagccugaccagcagcagcaaguacaccuacagaagaaagcugaccaacccccuggaggagagccaggccgugaacuuccacguggagaucgaggagcaggccaucggcguggacgugcacgcccugggccacuggagcgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcagcaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8455 - RNA, 3408 nt, Artificial Sequence
  derived and/or modified CDS sequence (opt4) from HTNV(CGAa31MP7)__EF990925.1__GP
augggcaucuggaaguggcuggugauggccagccugguguggcccgccuucgcccugagaaacguguacgacaugaagaucgagugcccccacaccgugagcuucggcgagaacagcgugaucggcuacguggagcugccccccaugccccuggccgacaccacccagauggugcccgagagcagcugcagcauggacaaccaccagagccugaacaccaucaccaaguacacccagaucaucuggagaggcaaggccgaccagagccagagcagccagaacagcuucgagaccgugagcaccggcguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaacugcaacgacaccgagaacaaggugcagggcuacuacaucugcaucaucggcggcaacagcagccccguguacgugcccacccuggacgacuucagaagcauggaggccuucagcggcaucuucagaagcccccacggcgaggaccacgaccuggccggcgaggagguggccagcuacagcaucgugggccccgccaacgccaaggugccccacagcgccagcagcgacacccugggccugaucgccuacagcggcauccccagcuacagcagccugagcauccugaccagcagcaccgaggccaagcacguguucagccccggccuguucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugaaccccguguggaacgacaacgcccacggcgugggcagcauccccaugcacaccgaccuggagcuggacuucagccugaccagcagcagcaagcacaccuacagaagaaagcugaccaacccccuggaggagagccaggccaucgaccugcacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcggcuacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8456 - RNA, 3408 nt, Artificial Sequence
  derived and/or modified CDS sequence (opt4) from HTNV(CGAa4MP9)__EF990929.1__GP
auggagaucuggaaguggcuggugauggccagccugguguggcccgcccuggcccugagaaacguguacgacaugaagaucgagugcccccacaccgugagcuucggcgagaacagcgugcugggcuacguggagcugccccccaugccccuggccgacaccauccagauggugcccgagagcagcugcagcauggacaaccaccagagcaugagcaccgccaccaaguacacccaggugagcuggagaggcaaggccgaccaggcccagagcagccagaccagcuucgagaccgugagcguggagguggaccugaagggcaccugcgugcugaagcacaagaugguggagaagagcuacagaagcagaaagagccugaccugcuacgaccugagcugcaacagcaccuacugcaagcccacccuguacaugaucgugcccauccacgccugcaacaugaugaagagcugcaucaucgcccugggccccuacagagugcaggugguguacgagagaaccuacugcaugaccggcgugcugcuggagggcaagugcuucgugcccgaccagagcguggugagcaucgugaagcacagcaucuucgacaucgccagcgugcacaucgccugcuucuucguggccaucaccggcaacaccuacaagcugaucgagcaggugaagaccagcuucggcaccaccugcaacgacaccgaggacaaggugcagggcuacuacaucugcauccugggcggcaacagcccccccaucuacgugcccacccuggacgacuucagaagcauggaggccuucagcggcaucuucagaagcccccacggcgaggaccacgaccuggccggcgaggagaucgccagcuacagcaucgugggccccgccaacgccaagaucccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucguggugcugaccgugcugaaguucaucgccaacaucuuccacaccagcaaccaggagaacagacugaagauggugcugaagaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgagagcgccuuccaggcccacuacagagugugccaggugacccacagauucagagaggaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugagccccaccuggaacgacaacgcccacggcgugggcagcauccccaugcacaccgaccuggagcuggacuucagccugaccagcagcagcaaguacaccuacagaagaaagcugaccaacccccuggaggaggcccaggccgugagcuuccacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacauggacgacugcuucgugagcagacacgugaaggugugcaucaucggcaccgugagcaaguucagccagggcgacacccugcuguucuucggcccccuggagggcggcggccugaucuacaagcacuggugcaccagcaccugccaguucggcgaccccggcgacaucaugagccccagagacaagggccugcugugccccgaguuccccggcagcuucagaaagaagugcaacuucgccaccacccccgugugcgaguacgacggcaacauggugagcggcuacaagaaggugauggccaccaucgacagcuuccagagcaucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8457 - RNA, 3408 nt, Artificial Sequence
  derived and/or modified CDS sequence (opt4) from HTNV(CGAa4P15)__EF990928.1__GP
auggagaucuggaaguggcuggugauggccagccugguguggcccgcccuggcccugagaaacguguacgacaugaagaucgagugcccccacaccgugagcuucggcgagaacagcgugcugggcuacguggagcugccccccaugccccuggccgacaccauccagauggugcccgagagcagcugcagcauggacaaccaccagagcaugagcaccgccaccaaguacacccaggugagcuggagaggcaaggccgaccaggcccagagcagccagaccagcuucgagaccgugagcguggagguggaccugaagggcaccugcgugcugaagcacaagaugguggagaagagcuacagaagcagaaagagccugaccugcuacgaccugagcugcaacagcaccuacugcaagcccacccuguacaugaucgugcccauccacgccugcaacaugaugaagagcugcaucaucgcccugggccccuacagagugcaggugguguacgagagaaccuacugcaugaccggcgugcugcuggagggcaagugcuucgugcccgaccagagcguggugagcaucgugaagcacagcaucuucgacaucgccagcgugcacaucgccugcuucuucguggccaucaccggcaacaccuacaagcuguucgagcaggugaagaccagcuucggcaccaccugcaacgacaccgaggacaaggugcagggcuacuacaucugcauccugggcggcaacagcccccccaucuacgugcccacccuggacgacuucagaagcauggaggccuucagcggcaucuucagaagcccccacggcgaggaccacgaccuggccggcgaggagaucgccagcuacagcaucgugggccccgccaacgccaagaucccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucguggugcugaccgugcugaaguucaucgccaacaucuuccacaccagcaaccaggagaacagacugaagauggugcugaagaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgagagcgccuuccaggcccacuacagagugugccaggugacccacagauucagagaggaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugagccccaccuggaacgacaacgcccacggcgugggcagcauccccaugcacaccgaccuggagcuggacuucagccugaccagcagcagcaaguacaccuacagaagaaagcugaccaacccccuggaggaggcccaggccgugagcuuccacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacauggacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcaucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8458 - RNA, 3408 nt, Artificial Sequence
  derived and/or modified CDS sequence (opt4) from HTNV(CGAa75)__EU092224.1__GP
auggagaucuggaaguggcuggugauggccagccugguguggcccgcccuggcccugagaaacgugcacgacaugaagaucgagugcccccacaccgugagcuucggcaagaacagcgugaucggcuacguggagcugccccccaugccccuggccgacaccauccagauggugcccgagagcagcugcagcauggacaaccaccagagccugagcaccgugaccaagcacacccaggugagcuggagaggcaaggccgaccaggcccagagcagccagaccagcuucgagaccgugagcguggagguggaccugaagggcaccugcgugcugaagcacaagcugguggaggagagcuacagaagcagaaagagccugaccugcuacgaccugagcugcaacagcaccuacugcaagcccacccuguacaugaucgugcccauccacgccugcaacaugaugaagagcugcaucaucgcccugggcccccacagagugcaggugguguacgagagaaccuacugcaugaccggcgugcugcuggagggcaagugcuucgugcccgaccagagcguggugagcaucgugagacacggcaucuucgacaucgccagcgugcacaucgccugcuucuucguggccaucaccggcaacaccuacaagcuguucgagcaggugaagaagagcuucggcaccaccugcaacgacaccgagaacaaggugcagggcuacuacaucugcauccugggcggcaacagcccccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcugaucaccuucugcuucggcugggugcugauccccgcccugaccuucaucgugcugaccgugcugaaguucaucgccaacaucuuccacaccagcaaccaggagaacagacugaagauggugcugaagaagaucaaggaggaguucgagagaaccaagggcagcauggugugcgacaucugcaaguacgagugcgagaccaacaaggagcugaaggcccacggcgugagcugcccccagagccagugccccuacugcuucacccacugcgagcccaccgagagcgccagccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugagccccaccuggaacgacaacgcccacggcgugggcagcauccccaugcacaccgaccuggagcuggacuucagccugaccagcagcagcaaguacaccuacagaagaaagcugaccaacccccuggaggagagccaggccgugaacuuccacguggagaucgaggagcaggccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaucgugaucgacaugaacgacugcuucgugagcagacacgugaaggugugcaucaucggcaccgugagcaaguucagccagggcgacacccugcuguucuucggcccccuggagggcggcggccugauccugaagcacuggugcaccagcaccugccaguucggcgaccccggcgacaucaugagccccagagacaagggcuuccugugccccgaguuccccggcagcuucagaaagaagugcaacuucgccaccacccccgugugcgaguacggcggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaaggagagcuga

SEQ ID NO: 8459 - RNA, 3408 nt, Artificial Sequence
  derived and/or modified CDS sequence (opt4) from HTNV(CGHu2)__EU363819.1__GP
augggcaucuggaaguggcuggugauggccagccugguguggcccgccuucgcccugagaaacguguacgacaugaagaucgagugcccccacaccgugagcuucggcgagaacagcgugaucggcuacguggagcugccccccaugccccuggccgacaccacccagauggugcccgagagcagcugcagcauggacaaccaccagagccugaacaccaucaccaaguacacccagaucaucuggagaggcaaggccgaccagagccagagcagccagaacagcuucgagaccgugagcaccggcguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuacguggccgugaagggcaacaccuacaagaucuucgagcaggugaagaagagcuucgagagcaacugcaacgacaccgagaacaaggugcagggcuacuacaucugcaucaucggcggcaacagcagccccguguacgugcccacccuggacgacuucagaagcauggaggccuucagcggcaucaucagaagcccccacggcgaggaccacgaccuggccggcgaggagguggccagcuacagcaucgugggccccgccaacgccaaggugccccacagcgccagcagcgacacccugggccugaucgccuacagcggcauccccagcuacagcagccugagcauccugaccagcagcaccgaggccaagcacguguucagccccggccuguucccccagcugaaccacaccaagugcgacaagaccgccaucccccugaccuggaccggcaugaucgaccugcccggcuacuacgaggccauccaccccugcaccgugaucugcgugcugagcggccccggcgccagcugcgaggcccugagcgagggcggcaucuucaacaucaccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugaaccccguguggaacgacaacgcccacggcgugggcagcauccccaugcacaccgaccuggagcuggacuucagccugaccagcagcagcaagcacaccuacagaagaaagcugaccaacccccuggaggagagccaggccaucgaccugcacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcggcuacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8460 - RNA, 3408 nt, Artificial Sequence
  derived and/or modified CDS sequence (opt4) from HTNV(CGHu3)__EU363818.1__GP
auggagaucuggaaguggcuggugauggccagccugguguggcccgcccuggcccugagaaacgugcacgacaugaagaucgagugcccccacaccgugagcuucggcaagaacagcgugaucggcuacguggagcugccccccaugccccuggccgacaccauccagauggugcccgagagcagcugcagcauggacaaccaccagagccugagcaccgccaccaaguacacccaggugagcuggagaggcaaggccgaccaggcccagagcagccagaccagcuucgagaccgugagcguggagguggaccugaagggcaccugcgugcugaagcacaagcugguggaggagagcuacagaagcagaaagagccugaccugcuacgaccugagcugcaacagcaccuacugcaagcccacccuguacaugaucgugcccauccacgccugcaacaugaugaagagcugcaucaucgcccugggcccccacagagugcaggugguguacgagagaaccuacugcaugaccggcgugcugcuggagggcaagugcuucgugcccgaccagagcguggugagcaucgugagacacggcaucuucgacaucgccagcgugcacaucgccugcuucuucguggccaucaccggcaacaccuacaagcuguucgagcaggugaagaagagcuucggcaccaccugcaacgacaccgagaacaaggugcagggcuacuacaucugcauccugggcggcaacagcccccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacacccugaccagccuguucagccugcugcccggcguggcccacagcaucgccguggagcugugcgugcccggcuuccacggcugggccaccgccgcccugcugaucaccuucugcuucggcugggugcugauccccgcccugaccuucaucgugcugaccgugcugaaguucaucgccaacaucuuccacaccagcaaccaggagaacagacugaagauggugcugaagaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgagagcgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugagccccaccuggaacgacaacgcccacggcgugggcagcauccccaugcacaccgaccuggagcuggacuucagccugaccagcagcagcaaguacaccuacagaagaaagcugaccaacccccuggaggagagccaggccgugaacuuccacguggagaucgaggagcaggccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaaggugggccugagaaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8461 - RNA, 3408 nt, Artificial Sequence
  derived and/or modified CDS sequence (opt4) from HTNV(CGHu3612)__EF990923.1__GP
augggcaucuggaaguggcuggugauggccagccugguguggcccgccuucgcccugagaaaccuguacgacaugaagaucgagugcccccacaccgugagcuucggcgagaacagcgugaccggcuacguggagcugccccccaugccccuggccgacaccacccagauggugcccgagagcagcugcagcauggacaaccaccagagccugaacaccaucaccaaguacacccagaucaucuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucaucguggccgugaagggcaacaccuacaagaucuucgagcaggugaagaagaccuucgagagcaacugcaacgacaccgagaacaaggugcagggcuacuacaucugcaucaucggcggcaacagcagccccguguacgugcccacccuggacgacuucagaagcauggaggccuucagcggcaucaucagaagcccccacggcgaggaccacgaccuggccggcgaggagguggccagcuacagcaucgugggccccgccaacgccaaggugccccacagcgccagcagcgacacccugggccugaucgccuacagcagcauccccagcuacagcagccugagcauccugaccagcagcaccgaggccaagcacguguucagccccggccuguucagacagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucgccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaucccccugaaccccguguggaacgacaacgcccacggcgugggcagcauccccaugcacaccgaccuggagcuggacuucagccugaccagcagcagcaaguacaccuacagaagaaagcugaccaacccccuggaggagagccaggccaucgaccugcacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcauccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugcagcaccuuccugaccagcaucaaggccugcgacaaggccaucugcuacggcgccgagagcgugacccugaccagaggccagaacaccgugaaggugagcggcaagggcggccacagcggcagcagcuucaagugcugccacggcgaggagugcagccagaucggccugcacgccgccgccccccaccuggacaaggugaacggcaucagcgagauggagaacagcaagguguucgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8462 - RNA, 3408 nt, Artificial Sequence
  derived and/or modified CDS sequence (opt4) from HTNV(CGHu3614)__EF990922.1__GP
augggcaucuggaaguggcuggugauggccagccugguguggcccgccuucgcccugagaaaccuguacgacaugaagaucgagugcccccacaccgugagcuucggcgagaacagcgugaccggcuacguggagcugccccccaugccccuggccgacaccacccagauggugcccgagagcagcugcagcauggacaaccaccagagccugaacaccaucaccaaguacacccagaucaucuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagaccuucgagagcaacugcaacgacaccgagaacaaggugcagggcuacuacaucugcaucaucggcggcaacagcagccccguguacgugcccacccuggacgacuucagaagcauggaggccuucagcggcaucuucagaagcccccacggcgaggaccacgaccuggccggcgaggagguggccagcuacagcaucgugggccccgccaacgccaaggugccccacagcgccagcagcgacacccugggccugaucgccuacagcagcauccccagcuacagcagccugagcauccugaccagcagcaccgaggccaagcacguguucagccccggccuguucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucgccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaucccccugaaccccguguggaacgacaacgcccacggcgugggcagcauccccaugcacaccgaccuggagcuggacuucagccugaccagcagcagcaaguacaccuacagaagaaagcugaccaacccccuggaggagagccaggccaucgaccugcacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugcagcaccuuccugaccagcaucaaggccugcgacaaggccaucugcuacggcgccgagagcgugacccugaccagaggccagaacaccgugaaggugagcggcaagggcggccacagcggcagcagcuucaagugcugccacggcgaggagugcagccagaucggccugcacgccgccgccccccaccuggacaaggugaacggcaucagcgagauggagaacagcaagguguucgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8463 - RNA, 3408 nt, Artificial Sequence
  derived and/or modified CDS sequence (opt4) from HTNV(CGRn15)__EU363814.1__GP
auggagaucuggaaguggcuggugauggccagccugguguggcccgcccuggcccugagaaacgugcacgacaugaagaucgagugcccccacaccgugagcuucggcaagaacagcgugaucggcuacguggagcugccccccaugccccuggccgacaccauccagauggugcccgagagcagcugcagcauggacaaccaccagagccugagcaccgugaccaaguacacccaggugagcuggagaggcaaggccgaccaggcccagagcagccagaccagcagcgagaccgugagcguggagguggaccugaagggcaccugcgugcugaagcacaagcugguggaggagagcuacagaagcagaaagagccugaccugcuacgaccugagcugcaacagcaccuacugcaagcccacccuguacaugaucgugcccauccacgccugcaacaugaugaagagcugcaucaucgcccugggcccccacagagugcaggugguguacgagagaaccuacugcaugaccggcgugcugcuggagggcaagugcuucgugcccgaccagagcguggugagcaucgugagacacggcaucuucgacaucgccagcgugcacaucgccugcuucuucguggccaucaccggcaacaccuacaagcuguucgagcaggugaagaagagcuucggcaccaccugcaacgacaccgagaacaaggugcagggcuacuacaucugcauccugggcggcaacagcccccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcugaucaccuucugcuucggcugggugcugauccccgcccugaccuucaucgugcugaccgugcugaaguucaucgccaacaucuuccacaccagcaaccaggagaacagacugaagauggugcugaagaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgagagcgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugagccccaccuggaacgacaacgcccacggcgugggcagcauccccaugcacaccgaccuggagcuggacuucagccugaccagcagcagcaaguacaccuacagaagaaagcugaccaacccccuggaggagagccaggccgugaacuuccacguggagaucgaggagcaggccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcagcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcagcaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8464 - RNA, 3408 nt, Artificial Sequence
  derived and/or modified CDS sequence (opt4) from HTNV(CGRn2616)__EU363816.1__GP
auggagaucuggaaguggcuggugauggccagccugguguggcccgcccuggcccugagaaacgugcacgacaugaagaucgagugcccccacaccgugagcuucggcaagaacagcgugaucggcuacguggagcugccccccaugccccuggccgacaccauccagauggugcccgagagcagcugcagcauggacaaccaccagagccugagcaccgugaccaagcacacccaggugagcuggagaggcaaggccgaccaggcccagagcagccagaccagcuucgagaccgugagcguggagguggaccugaagggcaccugcgugcugaagcacaagcugguggaggagagcuacagaagcagaaagagccugaccugcuacgaccugagcugcaacagcaccuacugcaagcccacccuguacaugaucgugcccauccacgccugcaacaugaugaagagcugcaucaucgcccugggcccccacagagugcaggugguguacgagagaaccuacugcaugaccggcgugcugcuggagggcaagugcuucgugcccgaccagagcguggugagcaucgugagacacggcaucuucgacaucgccagcgugcacaucgccugcuucuucguggccaucaccggcaacaccuacaagcuguucgagcaggugaagaagagcuucggcaccaccugcaacgacaccgagaacaaggugcagggcuacuacaucugcauccugggcggcaacagcccccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcugaucaccuucugcuucggcugggugcugauccccgcccugaccuucaucgugcugaccgugcugaaguucaucgccaacaucuuccacaccagcaaccaggagaacagacugaagauggugcugaagaagaucaaggaggaguucgagagaaccaagggcagcauggugugcgacaucugcaaguacgagugcgagaccaacaaggagcugaaggcccacggcgugagcugcccccagagccagugccccuacugcuucacccacugcgagcccaccgagagcgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugagccccaccuggaacgacaacgcccacggcgugggcagcauccccaugcacaccgaccuggagcuggacuucagccugaccagcagcagcaaguacaccuacagaagaaagcugaccaacccccuggaggagagccaggccgugaacuuccacguggagaucgaggagcaggccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaucgugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacggcggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8465 - RNA, 3408 nt, Artificial Sequence
  derived and/or modified CDS sequence (opt4) from HTNV(CGRn2618)__EU363817.1__GP
auggagaucuggaaguggcuggugauggccagccugguguggcccgcccuggcccugagaaacgugcacgacaugaagaucgagugcccccacaccgugagcuucggcaagaacagcgugaucggcuacguggagcugccccccaugccccuggccgacaccauccagauggugcccgagagcagcugcagcauggacaaccaccagagccugagcaccgugaccaaguacacccaggugagcuggagaggcaaggccgaccaggcccagagcagccagacccccuucgagaccgugagcguggagguggaccugaagagaaccugcgugcugaagcacaagcugguggaggagagcuacagaagcagaaagagccugaccugcuacgaccugagcugcaacagcaccuacugcaagcccacccuguacaugaucgugcccauccacgccugcaacaugaugaagagcugcaucaucgcccugggcccccacagagugcaggugguguacgagagaaccuacugcaugaccggcgugcugcuggagggcaagugcuucgugcccgaccagagcguggugagcaucgugagacacggcaucuucgacaucgccagcgugcacaucgccugcuucuucguggccaucaccggcaacaccuacaagcuguucgagcaggugaagaagagcuucggcaccaccugcaacgacaccgagaacaaggugcagggcuacuacaucugcauccugggcggcaacagcccccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcugaucaccuucugcuucggcugggugcugauccccgcccugaccuucaucgugcugaccgugcugaaguucaucgccaacaucuuccacaccagcaaccaggagaacagacugaagauggugcugaagaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgagagcgccuuccaggcccacuacagagugugccaggugacccacagauucagagacgaccugaagaagaccgugaccccccagaacuucacccccggcugcuacagaacccugaaccuguucagauacaagagcagaugcuacauccugaccauguggaaccugcugcugauccccggcuacagacugugggccgccagcgccagcgagaucccccugagccccaccuggaacgacaacgcccacggcgugggcagcauccccaugcacaccgaccuggagcuggacuucagccugaccagcagcagcaaguacaccuacagaagaaagcugaccaacccccuggaggagagccaggccgugaacuuccacguggagaucgaggagcaggccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaucgugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacggcggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8466 - RNA, 3408 nt, Artificial Sequence
  derived and/or modified CDS sequence (opt4) from HTNV(CGRn45)__EU092225.1__GP
auggagaucuggaaguggcuggugauggccagccugguguggcccgcccuggcccugagaaacgugcacgacaugaagaucgagugcccccacaccgugagcuucggcaagaacagcgugaucggcuacguggagcugccccccaugccccuggccgacaccauccagauggugcccgagagcagcugcagcauggacaaccaccagagccugagcaccgugaccaaguacacccaggugagcuggagaggcaaggccgaccaggcccagagcagccagaccagcuucgaggccgugagcguggagguggaccugaagggcaccugcgugcugaagcacaagcugguggaggagagcuacagaagcagaaagagccugaccugcuacgaccugagcugcaacagcaccuacugcaagcccacccuguacaugaucgugcccauccacgccugcaacaugaugaagagcugcaucaucgcccugggcccccacagagugcaggugguguacgagagaaccuacugcaugaccggcgugcugcuggagggcaagugcuucgugcccgaccagagcguggugagcaucgugagacacggcaucuucgacaucgccagcgugcacaucgccugcuucuucguggccaucaccggcaacaccuacaagcuguucgagcaggugaagaagagcuucggcaccaccugcaacgacaccgagaacaaggugcagggcuacuacaucugcauccugggcggcaacagcccccccaucuacgugcccacccuggacgacuucagaagcauggaggccuucagcggcaucuucaagagcccccacggcgaggaccacgaccuggccggcgaggagaucgccagcuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguucccccagcugaaccacaccaagugcgacaagaccgccaucccccugaccuggaccggcaucaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcugaucaccuucugcuucggcugggugcugauccccgcccugaccuucaucgugcugaccgugcugaaguucaucgccaacaucuuccacaccagcaaccaggagaacagacugaagauggugcugaagaagaucaaggaggaguucgagagaaccaagggcagcauggugugcgacaucugcaaguacgagugcgagaccuacaaggagcugaaggcccacggcgugagcugcccccagagccagugccccuacugcuucacccacugcgagcccaccgagagcgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggaucugccugcuggugcuggagagcauccugugggccgccagcgccagcgagaucccccugagccccaccuggaacgacaacgcccacggcgugggcagcauccccaugcacaccgaccuggagcuggacuucagccugaccagcagcagcaaguacaccuacagaagaaagcugaccaacccccuggaggagagccaggccgugaacuuccacguggagaucgaggagcaggccaucggcguggacgugcacgcccugggccacugguucgacggcagacugaaccugaagaccagcuuccacugcuacggcgccugcaccaaguacgaguaccccuggcacaccgccaagugccacuacgagagagaccaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacagaaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8467 - RNA, 3408 nt, Artificial Sequence
  derived and/or modified CDS sequence (opt4) from HTNV(CGRn53)__EF990921.1__GP
augggcaucuggaaguggcuggugauggccagccugguguggcccgccuacacccugagaaacguguacgacaugaagaucgagugcccccacaccgugagcuucggcgagaacagcgugaucggcuacguggagcugccccccaucccccuggccgacaccacccagauggugcccgagagcagcugcagcauggacaaccaccagagccugaacaccaucaccaaguacacccaggugagcuggagaggcaaggccggccaggcccaggccagccagaacagcuucgaggccgugagcgccgagguggaccugaagggcaccugcgugcugaagcacaagaugcuggaggagagcuacagaagcagaaagagcaucgccugcuacgaccugagcugcaacagcaccuacugcaagcccacccuguacaugaucgugcccauccacgccugcaacaugaugaagagcugccugaucgcccugggcccccacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcagaucaagaagagcuucgagagcaccugcaacgacaccaagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaccgccuacagcggcauccccagcuacagcagccugagcauccuggccggcagcgccgaggccaagcacguguucagccccggcuucuucccccagcugaaccacaccaagugcgacaagaccgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaugaccuucaucgugcugaccauccugaaguucaucgccaacaucuuccacaccagcaaccaggagaacaagcugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacauccugaccauguggaaccugcugcuggugcccggcuacagagccugggccgccagcgccagcgagaucccccugaaccccguguggaacgacaacgcccacggcgugggcagcgugcccaugcacaccgaccuggagcuggacuucagccugaccagcagcagcaaguacaccuacagaagaaagcugaccaacccccuggaggagagccaggccaucaaccugcacaucgagaucgaggagcagaccaucggcguggacgugcacgcccugggccacugguucgugggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgagaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcaucaagugcugguucgugaagagcggcgaguggaucagcggcaucuucagcggcaacuggaucgugcugaucgugcugugcguguuccugcuguucagccugauccugcugagcauccugugccccgugagaaagcacaagaagagcuga

SEQ ID NO: 8468 - RNA, 3408 nt, Artificial Sequence
  derived and/or modified CDS sequence (opt4) from HTNV(CGRn93MP8)__EF990919.1__GP
augggcaucuggaaguggcuggugaaggccagccugguguggcccgccuacacccugagaaacguguacgacaugaagaucgagugcccccacaccgugagcuucggcgagaacagcgugaucggcuacguggagcugccccccaucccccuggccgacaccacccacauggugcccgagagcagcugcagcauggacaaccaccagagccugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucgccugcuacgaccugagcugcaacagcaccuacugcaagcccacccuguacaugaucgugcccauccacgccugcaacaugaugaagagcugccugaucgcccugggcccccacagagugcaggugguguacgagagaaccuacugcaugaccggcuuccugaucgagggcaagugcuucgugcccgacagaagcguggugagcaucaucaagcacggcaucuucgacaucgccagcgugcacaucgugugcuucuucguggccgugaagggcaacaccuacaagaucuucgagcagaucaagaagagcuucgagagcaccugcaacgacaccaagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaccgccuacagcggcauccccagcuacagcagccugagcauccuggccggcagcgccgaggccaagcacguguucagccccggcuuccugccccagcugaaccacaccaagugcgacaagaccgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaugaccuucaucgugcugaccauccugaaguucaucgccaacaucuuccacaccagcaaccaggagaacaagcugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaucccccugaaccccguguggaacgacaacgcccacggcgugggcagcgugcccaugcacaccgaccuggagcuggacuucagccugaccagcagcagcaaguacaccuacagaagaaagcugaccaacccccuggaggagagccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgagaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcaucaagugcugguucgugaagagcggcgaguggaucagcggcaucuucagcggcaacuggaucgugcugaucgugcugugcguguuccugcuguucagccugauccugcugagcauccugugccccgugagaaagcacgagaagagcuga

SEQ ID NO: 8469 - RNA, 3408 nt, Artificial Sequence
  derived and/or modified CDS sequence (opt4) from HTNV(CGRn93P8)__EF990918.1__GP
augggcaucuggaaguggcuggugauggccagccugguguggcccgccuacacccugagaaacguguacgacaugaagaucgagugcccccacaccgugagcuucggcgagaacagcgugaucggcuacguggagcugccccccaucccccuggccgacaccacccagauggugcccgagagcagcugcagcauggacaaccaccagagccugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucgccugcuacgaccugagcugcaacagcaccuacugcaagcccacccuguacaugaucgugcccauccacgccugcaacaugaugaagagcugccugaucgcccugggcccccacagagugcaggugguguacgagagaaccuacugcaugaccggcgugcugaucgagggcaagugcuucgugcccgacagaagcguggugagcaucaucaagcacggcaucuucgacaucgccagcgugcacaucgugugcuucuucguggccgugaagggcaacaacuacaagaucuucgagcagaucaagaagagcuucgagagcaccugcaacgacaccaagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaccgccuacagcggcauccccagcuacagcagccugagcauccuggccggcagcgccgaggccaagcacguguucagccccggcuucuucccccagcugaaccacaccaagugcgacaagaccgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaugaccuucaucgugcugaccauccugaaguucaucgccaacaucuuccacaccagcaaccaggagaacaagcugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccgugugcuacagaacccugaaccuguucagauacaagagcagaugcuacaucuucaccauguggguguuccugcuggugcuggagagcauccugugggccgccagcgccagcgagaucccccugaaccccguguggaacgacaacgcccacggcgugggcagcgugcccaugcacaccgaccuggagcuggacuucagccugaccagcagcagcaaguacaccuacagaagaaagcugaccaacccccuggaggagagccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccaucugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagagcggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8470 - RNA, 3408 nt, Artificial Sequence
  derived and/or modified CDS sequence (opt4) from HTNV(CGRni1)__EU363815.1__GP
augggcaucuggaaguggcuggugauggccagccugguguggcccgccuucgcccugagaaaccuguacgacaugaagaucgagugcccccacaccgugagcuucggcgagaacagcgugaccggcuacguggagcugccccccaugccccuggccgacaccacccagauggugcccgagagcagcugcagcauggacaaccaccagagccugaacaccaucaccaaguacacccagaucaucuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuacguggccgugaagggcaacaccuacaagaucuucgagcaggugaagaagaccuucgagagcaacugcaacgacaccgagaacaaggugcagggcuacuacaucugcaucaucggcggcaacagcagccccguguacgugcccacccuggacgacuucagaagcauggaggccuucagcggcaucaucagaagcccccacggcgaggaccacgaccuggccggcgaggagguggccagcuacagcaucgugggccccgccaacgccaaggugccccacagcgccagcagcgacacccugggccugaucgccuacagcagcauccccagcuacagcagccugagcauccugaccagcagcaccgaggccaagcacguguucagccccggccuguucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucgccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagagaaccaugggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccagacagaacuucacccccggcugcuacagaacccugaaccuguucagauacaagagcagaugcuacaucuucaccauguggguguuccugaucgugcuggagagcauccugugggccgccagcgccagcgagaucccccugaaccccguguggaacgacaacgcccacggcgugggcagcauccccaugcacaccgaccuggagcuggacuucagccugaccagcagcagcaaguacaccuacagaagaaagcugaccaacccccuggaggagagccaggccaucgaccugcacguggagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccgugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugcagcaccuuccugaccagcaucaaggccugcgacaaggccaucugcuacggcgccgagagcgugacccugaccagaggccagaacaccgugaaggugagcggcaagggcggccacagcggcagcagcuucaagugcugccacggcgaggagugcagccagaucggccugcacgccgccgccccccaccuggacaaggugaacggcaucagcgagauggagaacagcaagguguucgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8471 - RNA, 3408 nt, Artificial Sequence
  derived and/or modified CDS sequence (opt4) from HTNV(Aa10-434)__KU207160.1__GP
augggcaucuggaaguggcuggugauggccagccugguguggcccgugcugacccugagaaacguguacgacaugaagaucgagugcccccacaccgugagcuucggcggcaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaucagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccaucagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcaggccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8472 - RNA, 3408 nt, Artificial Sequence
  derived and/or modified CDS sequence (opt4) from HTNV(Aa10-518)__KU207161.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccaagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucguggacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8473 - RNA, 3408 nt, Artificial Sequence
  derived and/or modified CDS sequence (opt4) from HTNV(Aa13_3)__KX687227.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccugguggacaccgugcagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8474 - RNA, 3408 nt, Artificial Sequence
  derived and/or modified CDS sequence (opt4) from HTNV(Aa14_186)__KX687228.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacaacaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagguggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8475 - RNA, 3408 nt, Artificial Sequence
  derived and/or modified CDS sequence (opt4) from HTNV(Aa14_234)__KX687230.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaccagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccagcugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgacgagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8476 - RNA, 3408 nt, Artificial Sequence
  derived and/or modified CDS sequence (opt4) from HTNV(Aa14_239)__KX687231.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgacgagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8477 - RNA, 3408 nt, Artificial Sequence
  derived and/or modified CDS sequence (opt4) from HTNV(Aa14-172)__KU207162.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccugaccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacaacaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagguggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8478 - RNA, 3408 nt, Artificial Sequence
  derived and/or modified CDS sequence (opt4) from HTNV(Aa14-175)__KU207163.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagguggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8479 - RNA, 3408 nt, Artificial Sequence
  derived and/or modified CDS sequence (opt4) from HTNV(Aa14-184)__KU207164.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacaacaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagguggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8480 - RNA, 3408 nt, Artificial Sequence
  derived and/or modified CDS sequence (opt4) from HTNV(LR1)__AF288293.1__GP
augggcaucuggaaguggcuggugauggccagccugguguggcccgugcugacccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggacagagaccuggccggcgaggagaucgccagcuacagcaucgugggccccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagcagcaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucagauucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacggccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcggcacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccccugccccgugagaaagcacaagaagagcuga

SEQ ID NO: 8481 - RNA, 3408 nt, Artificial Sequence
  derived and/or modified CDS sequence (opt4) from HTNV(SN7)__AF288656.1__GP
augggcguguggaaguggcuggugauggccagccugguguggcccgccugcacccugagaaacguguacgacaugaagaucgagugcccccacaccgugagcuucggcgagaacagcgugaucggcuacguggagcugccccccaugccccuggccgacaccacccagcuggugcccgagagcagcugcagcauggacaaccaccagagccugaacaccaucaccaaguacacccaggugagcuggagaaagaaggccgaccaggcccagagcagccagaacagcuucgagaccgugagcguggagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugaagaucgugugcuucuucguggccgugaagagaaacaccuacaagcuguucgagcaggugaagaagagcuucgacagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagguggccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagaccauggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccugaccgugcugaaguucguggccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgaggugccccugaaccccaucuggaacgacaacgcccacggcgugggcagcgugcccaugcacaccgaccuggagcuggacuucagccugaccagcagcagcaaguacaccuacagaagaaagcugaccaacccccuggaggagacccaggccaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacaugaucagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaccggccugcacgccgccgccccccaccuggacaaggugaacggcaucagcgagagcgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8482 - RNA, 3408 nt, Artificial Sequence
  derived and/or modified CDS sequence (opt4) from HTNV(84FLi)__AF366569.1__GP
augggcguguggaaguggcuggugauggccagccugguguggcccgccugcacccugagaaacguguacgacaugaagaucgagugcccccacaccgugagcuucggcgagaacagcgugaucggcuacguggagcugccccccaugccccuggccgacaccacccagcuggugcccgagagcagcugcagcauggacaaccaccagagccugaacaccaucaccaaguacacccaggugagcuggagaaagaaggccgaccaggcccagagcagccagaacagcuucgagaccgugagcguggagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugaagaucgugugcuucuucguggccgugaagggcaacaccuacaagcuguucgagcaggugaagaagagcuucgacagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagguggccagcuacagcaucgugggccccgccaacgccaaggugccccacaacgccagcagcgacacccugagccugaucgccuacagcggcauccccagcuacagcagccugagcauccugaccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccaagcagcaggugaacuucgugugccagagaguggacauggacaucgugguguacugcaacggccagagaaaggugauccugaccaagaccauggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccugaccgugcugaaguucguggccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgaggugccccugaaccccaucuggaacgacaacgcccacggcgugggcagcgugcccaugcacaccgaccuggagcuggacuucagccugaccagcagcagcaaguacaccuacagaagaaagcugaccaacccccuggaggagacccaggccaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacaugaucagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaccggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8483 - RNA, 3408 nt, Artificial Sequence
  derived and/or modified CDS sequence (opt4) from HTNV(Aa08-1111)__KY594715.1__GP
augggcaucuggaaguggcuggugauggccagccugguguggcccguguucacccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgcccccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcaucaucaccagcagcaccgaggccaagcacguguucagccccggccuguuccccaagcugaaccacaccaacugcaacaagggcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucggccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagcaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8484 - RNA, 3408 nt, Artificial Sequence
  derived and/or modified CDS sequence (opt4) from HTNV(Aa09-189)__KY594716.1__GP
augggcaucuggaaguggcuggugauggccagccugguguggcccguguucacccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgcccccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcaucaucaccagcagcaccgaggccaagcacguguucagccccggccuguuccccaagcugaaccacaccaacugcgacaagggcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacaucugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucggccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagcaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8485 - RNA, 3408 nt, Artificial Sequence
  derived and/or modified CDS sequence (opt4) from HTNV(CJilin93)__AY748307.1__GP
augggcauguggaaguggcuggugaucgccagccugguguggcccgcccuggcccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagcaucaacaccaucaccaaguacacccaggugaccuggagaggcaaggccgaccccggccagagcagccagaacagcuucgagacccugagcgccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucaagagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgacgccaagcacguguucagccccggccuguuccccaagcugaaccacaccaacugcgacaagagcgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuacugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcgugcugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaacaucaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagcaagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8486 - RNA, 3408 nt, Artificial Sequence
  derived and/or modified CDS sequence (opt4) from HTNV(KHF,clone:4)__LC209208.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccaagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccuggccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcauccccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccccaacggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8487 - RNA, 3408 nt, Artificial Sequence
  derived and/or modified CDS sequence (opt4) from HTNV(KHF,clone:5)__LC209209.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccuggccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcauccccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccccaacggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8488 - RNA, 3405 nt, Artificial Sequence
  derived and/or modified CDS sequence (opt4) from HTNV__D00376.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgacgugcccagauacuacgacggcauccaccccuucaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccuggccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcauccccaugcacaccgaccuggagcuggacuucagccugaccagcagcagcaaguacaccuacagaagaaagcugaccaacccccuggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcugcggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggagaaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccccaacggccugcacgccgccgccccccaccuggacaaggugaacggcaucagcgagaucgagaacagcaaggaguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8489 - RNA, 3417 nt, Artificial Sequence
  derived and/or modified CDS sequence (opt4) from LANV(510B)__AF005728.1__GP
auggagggcuggcuguucaccauccugggcgugugcuacaucaugaccaccgugcugcccaagaccaucuacgagcugaagauggagugcccccacaccgugggccugggccagggcuacaucaucggcagcgccgagcugggccugaucgacaucgccaccgugcccgagaucaagcuggagagcagcugcaacuucgaccugcacaccaccagcagcacccagaagagcuucacccagcuggaguggagaaagaaggccgagaccaccgacaccacccaggccgccagcaccaccuucgaggcccagaccaagaccgugaacaucagaggcaccugcauccuggccagcgaccuguacgacacccugaagagagugaagaagaccgugcugugcuacgaccugaccugcaaccagacccagugccagcccaccguguaccugaucacccccgugggcaccugcaugagcaucagaagcugcauggccaaccugcugagcaacagaauccagaucaccuucgagaagacccacugcgugaccggccagcugguggagggccagugcuucaaccccagccacagccugacccugagccagcccccccacaccuacgacguggugacccugcccaccaccugcuucuucaccgccaagaaggccgaccaguacaagaucgugaagaccuucgagggcaucaucagcaagaccggcugcaccgagaacagcauccagggcuacuacgugugcuucaucggcagccacagcgagccccugaucauccccacccuggaggacaucagaagcgccgagcuggccagcagaaugcugcugcaccccagaggcgaggaccacgacccccugcagaacgcccaggccgugcugagaaucgugggccccaucaccgccaaggugcccagcagcagcagcaccgagacccugcagggcaucgccuucgccggcgugcccauguacagcagcuucagcacccuggugagaaacgccgaccccgaguacguguucagccccggcaucauccccgagagcaaccagagcgugugcgacaagaagacccugccccugaccuggaccggcuaccugcccaucagcggcgagauggagaaggugaccggcugcaccguguucugcacccuggccggccccggcgccaacugcgaggccuacagcgagagcggcaucuucaacaucagcagccccaccugccuggugaacaaggugcagagauucagaggcagcgagcagaagaucaacuucaugugccagagaaucgacaacaacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccaucgcccugcugagcaccuucugcuucggcuggcugcugauccccggcaucacccugaucgugcugaagauccugaagauccugaccuacagcugcagccacuacagcagcgagagcaaguucaagaugauccuggagaaggugaagguggaguaccagaagaccaugggcagcauggugugcgacaucugccaccacgagugcgagaccgugaaggagcuggagagccacaagcagagcugcguggagggccagugccccuacugcaugaccgugaccgaggccacccagagcgcccugcaggcccacuucagcaucugcaagcugaccggcagauuccacgaggcccugaagaagagccugaagaagcccgaggugcacagaggcugcuacagaacccugggcguguucagauacagaagcagaugcuacgugggccugguguggggcugccugcugaccaucgagcuggugcugugggccgccagcgccgagaccccccugcuggagcccggcuggagcgacaccgcccacggcgugggcgagcugccccugaagaccgaccuggagcuggacuucagccugcccagcagcagcagcuacagcuacagaagaagacugaccaaccccgccaacaaggaggagagccugcccuuccacuuccagauggagaagcaggugauccacgccgagauccagagccugggccacuggauggacgccaccuucaacaucaagaccgccuuccacugcuacggcgccugcaagcaguacagcuaccccuggcagaccgccaagugcuucuucgagaaggacuaccaguacgagaccggcuggggcugcaaccccggcgacugccccggcgugggcaccggcugcaccgccugcggcaucuaccuggacaagcugaagagcgugggcaaggccuacaaggugaucagccugaaguacaccagaaaggugugcauccagcugggcaccgagcaggugugcaagcacaucgacgccaacgacugccuggugacccccagcgugaaggugugcaucaucggcaccgugagcaagauccagcccagcgacacccugcuguuccugggcccccuggagcagggcggcgugauccugaagcaguggugcaccaccagcugcaccuucggcgaccccggcgacaucaugagcaccaccagcggcaugagaugccccgagcacaccggcagcuucagaaagaucugcggcuucgccaccacccccgugugcgaguaccagggcaacaccaucagcggcuaccagagacugauggccaccaaggacagcuuccagagcuucaaccugaccgacccccacaucaccagcagcaagcuggaguggaucgaccccgacggcaacaccagagaccacgugaaccugauccugaacagagacgugagcuuccaggaccugagcgacaaccccugcaagguggaccugcacacccagagcaucgacggcgccuggggcagcggcgugggcuucacccugaccugcguggugggccugaccgagugccccagcuucaucaccagcaucaaggccugcgaccuggccaugugcuacggcagcaccguggccacccuggccagaggcagcaacaccgugaagguggugggcaagggcggccacagcggcagcagcuucaagugcugccacgacagcgacugcagcagcgagggccugauggccagcgccccccaccuggagagagugaccggcuucaaccagaucgacagcgacaagguguacgacgacggcgccccccccugcagcuucaagugcugguucaccaagagcggcgaguggcugcugggcauccugaacggcaacuggaucgugaucgccgugcuggugaucauccugaucaucagcaucauccuguucagcuuccugugccccagaagaagccacaagaagaacguguga

SEQ ID NO: 8490 - RNA, 3402 nt, Artificial Sequence
  derived and/or modified CDS sequence (opt4) from LQUV(Longquan-Rs-32)__JX465402.1__GP
augaagagcauccugcugauccugcugcuggagcaggugagaagcaaggccaccaacgagaucaagcuggagugcccccacgaccagagaguggagaccggcuucagccacggcuucaccgaccugagccccauccuguacaccaagggccuguucaccaagcaccuggagaacaacugccccuucgacaucagcaucaucaacagacuggugagagacgugagaaucagcaccuggcaggccaagagcaccaacaccgacgccaccguggccagcgccaccagcuucgagaccaaggacaccgacgacaagcuggccggcgugugcggcuucuucgacgacaucaccaagcccaagcagggccagagaaaggccaucaucugcuacgaccugagcugcaaccagacccacugccugcccacccugcaccugaucuucccccagcaguucugccagagccugaagcagugcagcaucaacgccuacgaccacaagauccugaucaccaucagccugagcuucugccccgagggccugaucaucggcggcaacugcaucgugcccgugcuggcccagagccagcugcugcacaaccacaugaccuacaacaucaaggugaccugcuucuucgaguacagcauggccagagagagccuggacaacaaguuccuggaggagaugaacagacuggugcugggcagaaacugcgagaagaccgaguaccugggcggcuacgugugcuuccuggccggcuacggcaccgccauccacgugcccuacgacaacaccuaccugagcggcgccguggugaacagcaugaaggccaaccugcacggcgaggaccacgacagacugaagcugggcgacaccagcgccgugaucgccggcaaccugaaguucgugaucgacagcaccgcccccgagaagagcuaccagggcgagugcuucaccggccacaugggcuacaccagccuguacuucuaccccgugagaagcaagggcaaguacgugaccauccugaccaagggcgugauccccgugaucaacaagaccaccugcaugcccaagaucgugccccugguguggaccggcaugguggagaugagaggcaucgaggagaagcuggaggccugcaccaugcacugcaucauggugggcaacggcgccaccugcgaggccuucagcgccaccggcaucuucgacaucaagagcaccaccugccagaucggcaagacccacaaguacagaagaaccgaggaccagaucaccuucaccugccaggaccugaacaaggacaucagcgugaucugcaacggcgagaacaucaccgugcccgugaagagccugaucgugggccagugcaucuacaccaucaccagcaucuucagcaucuuccccgccaccgcccacagcaucgccaccgagaugugcgugcagggcauccacggcuggcugaccaucaucaucuucuucaccuucugcuucggcuggcugcugauccccauccugaccugccugaucaucaacaccaucgccuacagccugaucacccuggccuacuucaagaacggcgccagacugggcaaccugaucaagagaaugaagagcgaguuccagagaaccaucggcaacaccaccugcaacaucugccugagagagugcgagagcgagagcgaguacaagagccacgaggagcugugcaagaacggcagcugccccuacugcaugaaggacaucggcgugagccaggugcugcugaacgagcacuacaacgccugcaugcugaucgacagauacgagaagagacugacccacacccugaaccagaccccccuguacagcagaaaggugagaaagauccagagcuucagauacagaaacagaugcuucauccugaccguguggaucauccugcugaccguggagagccugaucugggccagcagcgccgaggacaucaagcccgcccccaaguggcagaacaccgcccacggcaucggcaccaucaagcugaacagcgacuacgagcuggacuucagcgugguggccggcagcgaguucacccacaagagaaugcugcagagccccgagagcggcaagaagaacauccccuucaccguguaccugagcgagcagcugaucaccagcaccgugcagauccugggcaacuggauggacgccgagaucaacgugaagagcguguuccacugcuacggcaccugcaagaaguacagcuaccccuggcagagcagccccugccacaaggagguggacuucgaguuccagagcagcuggggcugcaaccccaucagcugccccggcaucaacagcggcugcaccgccugcggcaccuacguggacaagcugaagaccaucgccaaggccuacagaaucaucaccgugaaguacagcagaaaggugugcuaccagaucggcaccaagaaggccugcaagacccuggagagcaacgacugccuggugagcaacggcgugaagaucugcgccaucggcaccaucagcacccugcagaccggcaugacccugguguucuucggcccccugaacggcggcgcccugcugaucaaggacuggugcaucagcagcugcaaguucggcgaccccggcgacaucaugcagaucagcaacaacaucaccugccccagcuucgacggcaccaugcagagagugugcagauucggccuggagcccaugugcagcuacagcggcaacaagaucagcggcgugaagagagugcuggagaccaaggacagcuaccugagcgugaaccugaccaagcccaagcuggugggcagcacccugcuguggaacagccuggacagcagcaucaaggaccacaucaacaucguggugagcaacgacaucgacuucgaggaccuggccgagacccccugcaaggugaccaucaagaaccugaagaucgagggcgccuggggcagcggcaucggcaucaagcugcacugcgaggugagccugagcgagugcagcgaguaccugaccaccaucaaggugugcgacaacgccaucugcuacggcggcaacguggcccaccugagcagaggccugaacaccgugaucaucaagggcgccggcggccacagcggcagcagcuucaagugcugccacgagaccagcugcagcgacaucggcuucaaggccgaggccccccaccuggccagaaucguggacgacggcaucaccaccagcaugagcuacagcgacggcgcccccgaggccggcaucgugagcuggaucuacaagguggccgaguggaucaagggcauguucaacggcaacugguucgugcugaucaucaugauccuguuccugaucaucagcaucgugcugcugaucuuccugugccccgugaagaaguacaaguga

SEQ ID NO: 8491 - RNA, 3402 nt, Artificial Sequence
  derived and/or modified CDS sequence (opt4) from LQUV(Longquan-Ra-25)__JX465397.1__GP
augaagagcauccugcugauccugcugcugggccaggugagaagcaaggccaccaacgagaucaagcuggagugcccccacgaccagagaguggagaccggcuucagccacggcuucaccgaccugagccccauccuguacaccaagggccuguucaccaagcaccuggagaacaacugccccuucgacaucagcaucaucaacagacuggugagagacgugagaaucagcaccuggcaggccaagagcaccaacaccgacgccaccguggccagcgccaccagcuucgagaccaaggacaccgacgacaagcuggccggcgugugcggcuucuucgacgacaucaccaagcccaagcagggccagagaaaggccaucaucugcuacgaccugagcugcaaccagacccacugccugcccacccugcaccugaucuucccccagcaguucugccagagccugaagcagugcagcaucaacgccuacgaccacaagauccugaucaccaucagccugagcuucugccccgagggccugaucaucggcggcaacugcaucgugcccgugcuggcccagagccagcugcugcacaaccacaugaccuacaacaucaaggugaccugcuucuucgaguacagcauggccagagagagccuggacaacaaguuccuggaggagaugaacagacuggugcugggcagaaacugcgagaagaccgaguaccugggcggcuacgugugcuuccuggccggcuacggcaccgccauccacgugcccuacgacaacaccuaccugagcggcgccguggugaacagcaugaaggccaaccugcacggcgaggaccacgacagacugaagcugggcgacaccagcgccgugaucgccggcaaccugaaguucgugaucgacagcaccgcccccgagaagagcuaccagggcgagugcuucaccggccacaugggcuacaccagccuguacuucuaccccgugagaagcaagggcaaguacgugaccauccugaccaagggcgugauccccgugaucaacaagaccaccugcaugcccaagaucgugccccugguguggaccggcaugguggagaugagaggcaucgaggagaagcuggaggccugcaccaugcacugcaucauggugggcaacggcgccaccugcgaggccuucagcgccaccggcaucuucgacaucaagagcaccaccugccagaucggcaagacccacaaguacagaagaaccgaggaccagaucaccuucaccugccaggaccugaacaaggacaucagcgugaucugcaacggcgagaacaucaccgugcccgugaagagccugaucgugggccagugcaucuacaccaucaccagcaucuucagcaucuuccccgccaccgcccacagcaucgccaccgagaugugcgugcagggcauccacggcuggcugaccaucaucaucuucuucaccuucugcuucggcuggcugcugauccccauccugaccugccugaucaucaacaccaucgccuacagccugaucacccuggccuacuucaagaacggcgccagacugggcaaccugaucaagagaaugaagagcgaguuccagagaaccaucggcaacaccaccugcaacaucugccugagagagugcgagagcgagagcgaguacaagagccacgaggagcugugcaagaacggcagcugccccuacugcaugaaggacaucggcgugagccaggugcugcugaacgagcacuacaacgccugcaugcugaucgacagauacgagaagagacugacccacacccugaaccagaccccccuguacagcagaaaggugagaaagauccagagcuucagauacagaaacagaugcuucauccugaccguguggaucauccugcugaccguggagagccugaucugggccagcagcgccgaggacaucaagcccgcccccaaguggcagaacaccgcccacggcaucggcaccaucaagcugaacagcgacuacgagcuggacuucagcgugguggccggcagcgaguucacccacaagagaaugcugcagagccccgagagcggcaagaagaacauccccuucaccguguaccugagcgagcagcugaucaccagcaccgugcagauccugggcaacuggauggacgccgagaucaacgugaagagcguguuccacugcuacggcaccugcaagaaguacagcuaccccuggcagagcagccccugccacaaggagguggacuucgaguuccagagcagcuggggcugcaaccccaucagcugccccggcaucaacagcggcugcaccgccugcggcaccuacguggacaagcugaagaccaucgccaaggccuacagaaucaucaccgugaaguacagcagaaaggugugcuaccagaucggcaccaagaaggccugcaagacccuggagagcaacgacugccuggugagcaacggcgugaagaucugcgccaucggcaccaucagcacccugcagaccggcaugacccugguguucuucggcccccugaacggcggcgcccugcugaucaaggacuggugcaucagcagcugcaaguucggcgaccccggcgacaucaugcagaucagcaacaacaucaccugccccagcuucgacggcaccaugcagagagugugcagauucggccuggagcccaugugcagcuacagcggcaacaagaucagcggcgugaagagagugcuggagaccaaggacagcuaccugagcgugaaccugaccaagcccaagcuggugggcagcacccugcuguggaacagccuggacagcagcaucaaggaccacaucaacaucguggugagcaacgacaucgacuucgaggaccuggccgagacccccugcaaggugaccaucaagaaccugaagaucgagggcgccuggggcagcggcaucggcaucaagcugcacugcgaggugagccugagcgagugcagcgaguaccugaccaccaucaaggugugcgacaacgccaucugcuacggcggcaacguggcccaccugagcagaggccugaacaccgugaucaucaagggcgccggcggccacagcggcagcagcuucaagugcugccacgagaccagcugcagcgacaucggcuucaaggccgaggccccccaccuggccagaaucguggacgacggcaucaccaccagcaugagcuacagcgacggcgcccccgaggccggcaucaucagcuggaucuacaagguggccgaguggaucaagggcauguucaacggcaacugguucgugcugaucaucaugauccuguuccugaucaucagcaucgugcugcugaucuuccugugccccgugaagaaguacaaguga

SEQ ID NO: 8492 - RNA, 3402 nt, Artificial Sequence
  derived and/or modified CDS sequence (opt4) from LQUV(Longquan-Ra-5)__JX465398.1__GP
augaagagcauccugcugauccugcugcugggccaggugagaagcaaggccaccaacgagaucaagcuggagugcccccacgaccagagaguggagaccggcuucagccacggcuucaccgaccugagccccauccuguacaccaagggccuguucaccaagcaccuggagaacaacugccccuucgacaucagcaucaucaacagacuggugagagacgugagaaucagcaccuggcaggccaagagcaccaacaccgacgccaccguggccagcgccaccagcuucgagaccaaggacaccgacgacaagcuggccggcgugugcggcuucuucgacgacaucaccaagcccaagcagggccagagaaaggccaucaucugcuacgaccugagcugcaaccagacccacugccugcccacccugcaccugaucuucccccagcaguucugccagagccugaagcagugcagcaucaacgccuacgaccacaagauccugaucaccaucagccugagcuucugccccgagggccugaucaucggcggcaacugcaucgugcccgugcuggcccagagccagcugcugcacaaccacaugaccuacaacaucaaggugaccugcuucuucgaguacagcauggccagagagagccuggacaacaaguuccuggaggagaugaacagacuggugcugggcagaaacugcgagaagaccgaguaccugggcggcuacgugugcuuccuggccggcuacggcaccgccauccacgugcccuacgacaacaccuaccugagcggcgccguggugaacagcaugaaggccaaccugcacggcgaggaccacgacagacugaagcugggcgacaccagcgccgugaucgccggcaaccugaaguucgugaucgacagcaccgcccccgagaagagcuaccagggcgagugcuucaccggccacaugggcuacaccagccuguacuucuaccccgugagaagcaagggcaaguacgugaccauccugaccaagggcgugauccccgugaucaacaagaccaccugcaugcccaagaucgugccccugguguggaccggcaugguggagaugagaggcaucgaggagaagcuggaggccugcaccaugcacugcaucauggugggcaacggcgccaccugcgaggccuucagcgccaccggcaucuucgacaucaagagcaccaccugccagaucggcaagacccacaaguacagaagaaccgaggaccagaucaccuucaccugccaggaccugaacaaggacaucggcgugaucugcaacggcgagaacaucaccgugcccgugaagagccugaucgugggccagugcaucuacaccaucaccagcaucuucagcaucuuccccgccaccgcccacagcaucgccaccgagaugugcgugcagggcauccacggcuggcugaccaucaucaucuucuucaccuucugcuucggcuggcugcugauccccauccugaccugccugaucaucaacaccaucgccuacagccugaucacccuggccuacuucaagaacggcgccagacugggcaaccugaucaagagaaugaagagcgaguuccagagaaccaucggcaacaccaccugcaacaucugccugagagagugcgagagcgagagcgaguacaagagccacgaggagcugugcaagaacggcagcugccccuacugcaugaaggacaucggcgugagccaggugcugcugaacgagcacuacaacgccugcaugcugaucgacagauacgagaagagacugacccacacccugaaccagaccccccuguacagcagaaaggugagaaagauccagagcuucagauacagaaacagaugcuucauccugaccguguggaucacccugcugaccguggagagccugaucugggccagcagcgccgaggacaucaagcccgcccccaaguggcagaacaccgcccacggcaucggcaccaucaagcugaacagcgacuacgagcuggacuucagcgugguggccggcagcgaguucacccacaagagaaugcugcagagccccgagagcggcaagaagaacauccccuucaccguguaccugagcgagcagcugaucaccagcaccgugcagauccugggcaacuggauggacgccgagaucaacgugaagagcguguuccacugcuacggcaccugcaagaaguacagcuaccccuggcagagcagccccugccacaaggagguggacuucgaguuccagagcagcuggggcugcaaccccaucagcugccccggcaucaacagcggcugcaccgccugcggcaccuacguggacaagcugaagaccaucgccaaggccuacagaaucaucaccgugaaguacagcagaaaggugugcuaccagaucggcaccaagaaggccugcaagacccuggagagcaacgacugccuggugagcaacggcgugaagaucugcgccaucggcaccaucagcacccugcagaccggcaugacccugguguucuucggcccccugaacggcggcgcccugcugaucaaggacuggugcaucagcagcugcaaguucggcgaccccggcgacaucaugcagaucagcaacaacaucaccugccccagcuucgacggcaccaugcagagagugugcagauucggccuggagcccaugugcagcuacagcggcaacaagaucagcggcgugaagagagugcuggagaccaaggacagcuaccugagcgugaaccugaccaagcccaagcuggugggcagcacccugcuguggaacagccuggacagcagcaucaaggaccacaucaacaucguggugagcaacgacaucgacuucgaggaccuggccgagacccccugcaaggugaccaucaagaaccugaagaucgagggcgccuggggcagcggcaucggcaucaagcugcacugcgaggugagccugagcgagugcagcgaguaccugaccaccaucaaggugugcgacaacgccaucugcuacggcggcaacguggcccaccugagcagaggccugaacaccgugaucaucaagggcgccggcggccacagcggcagcagcuucaagugcugccacgagaccagcugcagcgacaucggcuucaaggccgaggccccccaccuggccagaaucguggacgacggcaucaccaccagcaugagcuacagcgacggcgcccccgaggccggcaucgugagcuggaucuacaagguggccgaguggaucaagggcauguucaacggcaacugguucgugcugaucaucaugauccuguuccugaucaucagcaucgugcugcugaucuuccugugccccgugaagaaguacaaguga

SEQ ID NO: 8493 - RNA, 3402 nt, Artificial Sequence
  derived and/or modified CDS sequence (opt4) from LQUV(Longquan-Ra-56)__JX465399.1__GP
augaagagcauccugcugauccugcugcugggccaggugagaagcaaggccaccaacgagaucaagcuggagugcccccacgaccagagaguggagaccggcuucagccacggcuucaccgaccugagccccauccuguacaccaagggccuguucaccaagcaccuggagaacaacugccccuucgacaucagcaucaucaacagacuggugagagacgugagaaucagcaccuggcaggccaagagcaccaacaccgacgccaccguggccagcgccaccagcuucgagaccaaggacaccgacgacaagcuggccggcgugugcggcuucuucgacgacaucaccaagcccaagcagggccagagaaaggccaucaucugcuacgaccugagcugcaaccagacccacugccugcccacccugcaccugaucuucccccagcaguucugccagagccugaagcagugcagcaucaacgccuacgaccacaagauccugaucaccaucagccugagcuucugccccgagggccugaucaucggcggcaacugcaucgugcccgugcuggcccagagccagcugcugcacaaccacaugaccuacaacaucaaggugaccugcuucuucgaguacagcauggccagagagagccuggacaacaaguuccuggaggagaugaacagacuggugcugggcagaaacugcgagaagaccgaguaccugggcggcuacgugugcuuccuggccggcuacggcaccgccauccacgugcccuacgacaacaccuaccugagcggcgccguggugaacagcaugaaggccaaccugcacggcgaggaccacgacagacugaagcugggcgacaccagcgccgugaucgccggcaaccugaaguucgugaucgacagcaccgcccccgagaagagcuaccagggcgagugcuucaccggccacaugggcuacaccagccuguacuucuaccccgugagaagcaagggcaaguacgugaccauccugaccaagggcgugauccccgugaucaacaagaccaccugcaugcccaagaucgugccccugguguggaccggcaugguggagaugagaggcaucgaggagaagcuggaggccugcaccaugcacugcaucauggugggcaacggcgccaccugcgaggccuucagcgccaccggcaucuucgacaucaagagcaccaccugccagaucggcaagacccacaaguacagaagaaccgaggaccagaucaccuucaccugccaggaccugaacaaggacaucagcgugaucugcaacggcgagaacaucaccgugcccgugaagagccugaucgugggccagugcaucuacaccaucagcagcaucuucagcaucuuccccgccaccgcccacagcaucgccaccgagaugugcgugcagagcauccacggcuggcugaccaucaucaucuucuucaccuucugcuucggcuggcugcugauccccauccugaccugccugaucaucaacaccaucgccuacagccugaucacccuggccuacuucaagaacggcgccagacugggcaaccugaucaagagaaugaagagcgaguuccagagaaccaucggcaacaccaccugcaacaucugccugagagagugcgagagcgagagcgaguacaagagccacgaggagcugugcaagaacggcagcugccccuacugcaugaaggacaucggcgugagccaggugcugcugaacgagcacuacaacgccugcaugcugaucgacagauacgagaagagacugacccacacccugaaccagaccccccuguacagcagaaaggugagaaagauccagagcuucagauacagaaacagaugcuucauccugaccguguggaucauccugcugaccguggagagccugaucugggccagcagcgccgaggacaucaagcccgcccccaaguggcagaacaccgcccacggcaucggcaccaucaagcugaacagcgacuacgagcuggacuucagcgugguggccggcagcgaguucacccacaagagaaugcugcagagccccgagagcggcaagaagaacauccccuucaccguguaccugagcgagcagcugaucaccagcaccgugcagauccugggcaacuggauggacgccgagaucaacgugaagagcguguuccacugcuacggcaccugcaagaaguacagcuaccccuggcagagcagccccugccacaaggagguggacuucgaguuccagagcagcuggggcugcaaccccaucagcugccccggcaucaacagcggcugcaccgccugcggcaccuacguggacaagcugaagaccaucgccaaggccuacagaaucaucaccgugaaguacagcagaaaggugugcuaccagaucggcaccaagaaggccugcaagacccuggagagcaacgacugccuggugagcaacggcgugaagaucugcgccaucggcaccaucagcacccugcagaccggcaugacccugguguucuucggcccccugaacggcggcgcccugcugaucaaggacuggugcaucagcagcugcaaguucggcgaccccggcgacaucaugcagaucagcaacaacaucaccugccccagcuucgacggcaccaugcagagagugugcagauucggccuggagcccaugugcagcuacagcggcaacaagaucagcggcgugaagagagugcuggagaccaaggacagcuaccugagcgugaaccugaccaagcccaagcuggugggcagcacccugcuguggaacagccuggacagcagcaucaaggaccacaucaacaucguggugagcaacgacaucgacuucgaggaccuggccgagacccccugcaaggugaccaucaagaaccugaagaucgagggcgccuggggcagcggcaucggcaucaagcugcacugcgaggugagccugagcgagugcagcaaguaccugaccaccaucaaggugugcgacaacgccaucugcuacggcggcaacguggcccaccugagcagaggccugaacaccgugaucaucaagggcgccggcggccacagcggcagcagcuucaagugcugccacgagaccagcugcagcgacaucggcuucaaggccgaggccccccaccuggccagaaucguggacgacggcaucaccaccagcaugagcuacagcgacggcgcccccgaggccggcaucgugagcuggaucuacaagguggccgaguggaucaagggcauguucaacggcaacugguucgugcugaucaucaugauccuguuccugaucaucagcaucgugcugcugaucuuccugugccccgugaagaaguacaaguga

SEQ ID NO: 8494 - RNA, 3402 nt, Artificial Sequence
  derived and/or modified CDS sequence (opt4) from LQUV(Longquan-Ra-90)__JX465400.1__GP
augaagagcauccugcugauccugcugcugggccaggugagaagcaaggccaccaacgagaucaagcuggagugcccccacgaccagagaguggagaccggcuucagccacggcuucaccgaccugagccccauccuguacaccaagggccuguucaccaagcaccuggagaacaacugccccuucgacaucagcaucaucaacagacuggugagagacgugagaaucagcaccuggcaggccaagagcaccaacaccgacgccaccguggccagcgccaccagcuucgagaccaaggacaccgacgacaagcuggccggcgugugcggcuucuucgacgacaucaccaagcccaagcagggccagagaaaggccaucaucugcuacgaccugagcugcaaccagacccacugccugcccacccugcaccugaucuucccccagcaguucugccagagccugaagcagugcagcaucaacgccuacgaccacaagauccugaucaccaucagccugagcuucugccccgagggccugaucaucggcggcaacugcaucgugcccgugcuggcccagagccagcugcugcacaaccacaugaccuacaacaucaaggugaccugcuucuucgaguacagcauggccagagagagccuggacaacaaguuccuggaggagaugaacagacuggugcugggcagaaacugcgagaagaccgaguaccugggcggcuacgugugcuuccuggccggcuacggcaccgccauccacgugcccuacgacaacaccuaccugagcggcgccguggugaacagcaugaaggccaaccugcacggcgaggaccacgacagacugaagcugggcgacaccagcgccgugaucgccggcaaccugaaguucgugaucgacagcaccgcccccgagaagagcuaccagggcgagugcuucaccggccacaugggcuacaccagccuguacuucuaccccgugagaagcaagggcaaguacgugaccauccugaccaagggcgugauccccgugaucaacaagaccaccugcaugcccaagaucgugccccugguguggaccggcaugguggagaugagaggcaucgaggagaagcuggaggccugcaccaugcacugcaucauggugggcaacggcgccaccugcgaggccuucagcgccaccggcaucuucgacaucaagagcaccaccugccagaucggcaagacccacaaguacagaagaaccgaggaccagaucaccuucaccugccaggaccugaacaaggacaucagcgugaucugcaacggcgagaacaucaccgugcccgugaagagccugaucgugggccagugcaucuacaccaucaccagcaucuucagcaucuuccccgccaccgcccacagcaucgccaccgagaugugcgugcagggcauccacggcuggcugaccaucaucaucuucuucaccuucugcuucggcuggcugcugauccccauccugaccugccugaucaucaacaccaucgccuacagccugaucacccuggccuacuucaagaacggcgccagacugggcaaccugaucaagagaaugaagagcgaguuccagagaaccaucggcaacaccaccugcaacaucugccugagagagugcgagagcgagagcgaguacaagagccacgaggagcugugcaagaacggcagcugccccuacugcaugaaggacaucggcgugagccaggugcugcugaacgagcacuacaacgccugcaugcugaucgacagauacgagaagagacugacccacacccugaaccagaccccccuguacagcagaaaggugagaaagauccagagcuucagauacagaaacagaugcuucauccugaccguguggaucauccugcugaccguggagagccugaucugggccagcagcgccgaggacaucaagcccgcccccaaguggcagaacaccgcccacggcaucggcaccaucaagcugaacagcgacuacgagcuggacuucagcgugguggccggcagcgaguucacccacaagagaaugcugcagagccccgagagcggcaagaagaacauccccuucaccguguaccugagcgagcagcugaucaccagcaccgugcagauccugggcaacuggauggacgccgagaucaacgugaagagcguguuccacugcuacggcaccugcaagaaguacagcuaccccuggcagagcagccccugccacaaggagguggacuucgaguuccagagcagcuggggcugcaaccccaucagcugccccggcaucaacagcggcugcaccgccugcggcaccuacguggacaagcugaagaccaucgccaaggccuacagaaucaucaccgugaaguacagcagaaaggugugcuaccagaucggcaccaagaaggccugcaagacccuggagagcaacgacugccuggugagcaacggcgugaagaucugcgccaucggcaccaucagcacccugcagaccggcaugacccugguguucuucggcccccugaacggcggcgcccugcugaucaaggacuggugcaucagcagcugcaaguucggcgaccccggcgacaucaugcagaucagcaacaacaucaccugccccagcuucgacggcaccaugcagagagugugcagauucggccuggagcccaugugcagcuacagcggcaacaagaucagcggcgugaagagagugcuggagaccaaggacagcuaccugagcgugaaccugaccaagcccaagcuggugggcagcacccugcuguggaacagccuggacagcagcaucaaggaccacaucaacaucguggugagcaacgacaucgacuucgaggaccuggccgagacccccugcaaggugaccaucaagaaccugaagaucgagggcgccuggggcagcggcaucggcaucaagcugcacugcgaggugagccugagcgagugcagcgaguaccugaccaccaucaaggugugcgacaacgccaucugcuacggcggcaacguggcccaccugagcagaggccugaacaccgugaucaucaagggcgccggcggccacagcggcagcagcuucaagugcugccacgagaccagcugcagcgacaucggcuucaaggccgaggccccccaccuggccagaaucguggacgacggcaucaccaccagcaugagcuacagcgacggcgcccccgaggccggcaucgugagcuggaucuacaagguggccgaguggaucaagggcauguucaacggcaacugguucgugcugaucaucaugauccuguuccugaucaucagcaucgugcugcugaucuuccugugccccgugaagaaguacaaguga

SEQ ID NO: 8495 - RNA, 3423 nt, Artificial Sequence
  derived and/or modified CDS sequence (opt4) from NYV(Rhode Island-1 (RI-1))__U36801.1__GP
auggugggcugggugugcaucuuccugguggugcuggccaccaccaccgccggccugaccagaaaccuguacgagcugaagaucgagugcccccacaccgugggccugggccagggcuacgugaccggcagcguggagaccacccccauccugcugacccaggugaccgaccugaagaucgagagcagcugcaacuucgaccugcacgugcccagcaccagcauccagaaguacaaccagguggagugggccaagaagagcagcaccaccgagagcaccagcgccggcgccaccaccuucgaggccaagaccaaggaggugagccugaagggcaccugcaacauccccgugaccaccuucgaggccgccuacaagagcagaaagaccgugaucugcuacgaccuggccugcaaccagaccuacugccugcccaccgugcaccugaucgcccccgugcagaccugcaugagcgugagaagcugcaugaucggccugcugagcagcagaauccaggugaucuacgagaagaccuacugcgugaccggccagcugguggagggccugugcuucauccccacccacaccaucgcccugacccagcccggccacaccuacgacaccaugacccugcccaucaccugcuuccugguggccaagaagcugggcacccagcugaagaucgccguggagcuggagaagcugaucaccgccagcggcugcaccgagaacagcuuccagggcuacuacaucugcuuccugggcaagcacagcgagccccugagcgugcccaugauggacgacuacagaagcgccgagcuguucaccagaauggugcugaaccccagaggcgaggaccacgaccccgaccagaacggccagggccugaugagaaucgccggccccaucaccgccaaggugcccagcaccgagaccaccgagaccaugcagggcaucgccuucgccggcgcccccaccuacagcagcuucagcacccuggugagaaaggccgaccccgacuacguguucagccccggcaucaucgccgagagcaaccacagcgugugcgacaagaaggccaucccccugaccuggaccggcuuccuggccgugagcggcgagaucgagaagaucaccggcugcaccguguucugcacccuggugggccccggcgccagcugcaaggccuacagcgagaccggcaucuucaacaucagcagccccaccugccuggugaacaaggugcagaaguucagaggcagcgagcagagaaucaacuucaugugccagagaguggaccaggacgugaucguguacugcaacggccagaagaaggugauccugaccaagacccugaucaucggccagugcaucuacaccuucaccagccuguucagccugauccccggcguggcccacagccuggccguggagcugugcgugcccggccugcacggcugggccaccgccgcccugcugaucaccuucugcuucggcuggcugcugauccccaccaucaccaugaucauccugaagauccugagacugcugaccuucagcugcagccacuacagcaccgagagcaaguucaaggccauccuggagagagugaagguggaguaccagaagaccaugggcagcauggugugcgacgccugccaccacgagugcgagaccgccaaggagcuggagacccacaagaagagcugccccgagggccagugccccuacugcaugaccaugaccgagagcaccgagagcgcccugcuggcccacuucagcaucugcaagcugaccaacagauuccaggagaaccugaagaagagccugaagagacccgaggugaagcagggcagauacagaacccugggcguguucagauacaagagcagaugcuacgugggccugguguggggcgugcugcugaccaccgagcugaucgugugggccgccagcgccgacaccccccugauggagagcggcuggagcgacaccgcccacggcgugggcaucgugcccaugaagaccgaccuggagcuggacuucgcccuggccagcagcagcagcuacagcuacagaagaaagcuggugaaccccgccaacaaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcggcggcaaggccuacaagaucgugagccugaaguucaccagaaaggugugcauccagcugggcaccgagcagaccugcaagcacaucgacgugaacgacugccuggugacccccagcgugaaggugugccugaucggcaccaucagcaagcugcagcccggcgacacccugcuguuccugggcccccuggagcagggcggcaucauccugaagcaguggugcaccaccagcugcguguucggcgaccccggcgacaucaugagcaccaccaccggcaugaagugccccgagcacaccggcagcuucagaaagaucugcggcuucgccaccacccccaccugcgaguaccagggcaacaccaucagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcagcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccaucagaggcagaaagaacaagagcaacuga

SEQ ID NO: 8496 - RNA, 3423 nt, Artificial Sequence
  derived and/or modified CDS sequence (opt4) from NYV(New York-1 (NY-1))__U36802.1__GP
auggugggcugggugugcaucagccugguggugcuggccaccaccaccgccggccugaccagaaaccuguacgagcugaagaucgagugcccccacaccgugggccugggccagggcuacgugaccggcagcguggagaccacccccauccugcugacccaggugaccgaccugaagaucgagagcagcugcaacuucgaccugcacgugcccagcaccagcauccagaaguacaaccagguggagugggccaagaagagcagcaccaccgagagcaccagcgccggcgccaccaccuucgaggccaagaccaaggaggugagccugaagggcaccugcaacauccccgugaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugguggagggccugugcuucauccccacccacaccaucgcccugacccagcccggccacaccuacgacaccaugacccugcccaucaccugcuuccugguggccaagaagcugggcacccagcugaagaucgccguggagcuggagaagcugaucaccgccagcggcugcaccgagaacagcuuccagggcuacuacaucugcuuccugggcaagcacagcgagccccuguucgugcccaugauggacgacuacagaagcgccgagcuguucaccagaauggugcugaaccccagaggcgaggaccacgaccccgaccagaacggccagggccugaugagaaucgccggccccaucaccgccaaggugcccagcaccgagaccaccgagaccaugcagggcaucgccuucgccggcgcccccauguacagcagcuucagcacccuggugagaaaggccgaccccgacuacguguucagccccggcaucaucgccgagagcaaccacagcgugugcgacaagaagaccaucccccugaccuggaccggcuuccuggccgugagcggcgagaucgagaagaucaccggcugcaccguguucugcacccuggugggccccggcgccagcugcgaggccuacagcgagaccggcaucuucaacaucagcagccccaccugccuggugaacaaggugcagaaguucagaggcagcgagcagagaaucaacuucaugugccagagaguggaccaggacgugaucguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccaucaccaugaucauccugaagauccugagacugcugaccuucagcugcagccacuacagcaccgagagcaaguucaaggccauccuggagagagugaagguggaguaccagaagaccaugggcagcauggugugcgacgugugccaccacgagugcgagaccgccaaggagcuggagacccacaagaagagcugccccgagggccagugccccuacugcaugaccaugaccgagagcaccgagagcgcccugcaggcccacuucagcaucugcaagcugaccaacagauuccaggagaaccugaagaagagccugaagagacccgaggugaagcagggcugcuacagaacccugggcguguucagauacaagagcagaugcuacgugggccugguguggggcgugcugcugaccaccgagcugaucgugugggccgccagcgccgacaccccccugauggagagcggcuggagcgacaccgcccacggcgugggcaucgugcccaugaagaccgaccuggagcuggacuucgcccuggccagcagcagcagcuacagcuacagaagaaagcuggugaaccccgccaacaaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguucaccagaaaggugugcauccagcugggcaccgagcagaccugcaagcacaucgacgugaacgacugccuggugacccccagcgugaaggugugccugaucggcaccaucagcaagcugcagcccggcgacacccugcuguuccugggcccccuggagcagggcggcaucauccugaagcaguggugcaccaccagcugcguguucggcgaccccggcgacaucaugagcaccaccaccggcaugaagugccccgagcacaccggcagcuucagaaagaucugcggcuucgccaccacccccaccugcgaguaccagggcaacaccaucagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccaucagaggcagaaagaacaagagcaacuga

SEQ ID NO: 8497 - RNA, 3423 nt, Artificial Sequence
  derived and/or modified CDS sequence (opt4) from NYV(New York-2 (NY-2))__U36803.1__GP
auggugggcuucgugugcaucuuccugguggugcuggccaccaccaccgccggccugaccagaaaccuguacgagcugaagaucgagugcccccacaccgugggccugggccagggcuacgugaccggcagcgugggcaccacccccauccugcugacccaggugaccgaccugaagaucgagagcagcugcaacuucgaccugcacgugcccagcaccagcauccagaaguacaaccagguggagugggccaagaagagcagcaccaccgagagcaccagcgccggcgccaccaccuucgaggccaagaccaaggaggugagccugaagggcaccugcaacauccccgugaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugguggagggccugugcuucauccccacccacaccaucgcccugacccagcccggccacaccuacgacaccaugacccugcccaucaccugcuuccugguggccaagaagcugggcacccagcugaagaucgccguggagcuggagaagcugaucaccgccggcggcugcaccgagaacagcuuccagggcuacuacaucugcuuccugggcaagcacagcgagccccuguucgugcccaugauggacgacuacagaagcgccgagcuguucaccagaauggugcugaaccccagaggcgaggaccacgaccccgaccagaacggccagggccugaugagaaucgccggccccaucaccgccaaggugcccagcaccgagaccaccgaggccaugcagggcaucgccuucgccggcgcccccauguacagcagcuucagcacccuggugagaaaggccgaccccgacuacguguucagccccggcaucaucgccgagagcaaccacagcgugugcgacaagaagaccaucccccugaccuggaccggcuuccuggccgugagcggcgagaucgagaagaucaccggcugcaccguguucugcacccuggugggccccggcgccagcugcgaggccuacagcgagaccggcaucuucaacaucagcagccccaccugccuggugaacaaggugcagaaguucagaggcagcgagcagagaaucaacuucaugugccagagaguggaccaggacgugaucguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccaucaccaugaucauccugaagauccugagacugcugaccuucagcugcagccacuacagcaccgagagcaaguucaaggccauccuggagagagugaagguggaguaccagaagaccaugggcagcauggugugcgacgugugccaccacgagugcgagaccgccaaggagcuggagacccacaagaagagcugccccgagggccagugccccuacugcaugaccaugaccgagagcaccgagagcgcccugcaggcccacuucagcaucugcaagcugaccaacagauuccaggagaaccugaagaagagccugaagagacccgaggugaagcagggcugcuacagaacccugggcguguucagauacaagagcagaugcuacgugggccugguguggggcgugcugcugaccaccgagcugaucgugugggccgccagcgccgacaccccccugauggagagcggcuggagcgacaccgcccacggcgugggcaucgugcccaugaagaccgaccuggagcuggacuucgcccuggccagcagcagcagcuacagcuacagaagaaagcugguggaccccgccaacaaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguucaccagaaaggugugcauccagcugggcaccgagcagaccugcaagcacaucgacgugaacgacugccuggugacccccagcgugaaggugugccugaucggcaccaucagcaagcugcagcccggcgacacccugcuguuccugggcccccuggagcagggcggcaucauccugaagcaguggugcaccaccagcugcguguucggcgaccccggcgacaucaugagcaccaccaccggcaugaagugccccgagcacaccggcagcuucagaaagaucugcggcuucgccaccacccccaccugcgaguaccagggcaacaccaucagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccaucagaggcagaaagaacaagagcaacuga

SEQ ID NO: 8498 - RNA, 3447 nt, Artificial Sequence
  derived and/or modified CDS sequence (opt4) from PUUV(K27)__L08754.1__GP
augggcgagcugagccccgugugccuguaccugcugcugcagggccugcugcugugcaacaccggcgccgccagaaaccugaacgagcugaagauggagugcccccacaccaucagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugcagcaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugacccugugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccuga

SEQ ID NO: 8499 - RNA, 3447 nt, Artificial Sequence
  derived and/or modified CDS sequence (opt4) from PUUV(13891)__U22418.1__GP
augggcaagaucauccccgugugccuguaccugcuguuccugugccugcugcuguggaacagaggcgacgccagaaaccugaacgagcugaagauggagugcccccacaccaucggccugggccagggccuggugaucggcagcguggagcugccccccgugccccugacccagguggagagccugaagcuggagagcagcugcaacuucgaccugcacaccagcaccagcagccagcagagcuucaccaaguggaccugggagaucaagaacgaccuggccgagaacacccaggccagcagcaccagcuuccagaccaagagcagcgagaucaaccugagaggccugugccugauccccccccuggugaucgagaccgccgccagaaccagaaagaccaucgccugcuucgaccugagcugcaaccagaccgccugccagcccaccguguuccugaucggccccauccagaccugcaucaccaccaagagcugccugcugggccugggcgaccagagaauccaggugaacuacgagaagaccuacugcgugagcggccagcugguggagggcgugugcuucaaccccgugcacaccauggcccugagccagcccagccacaccuacgacaucgugaccgugauggugagaugcuuccugaucgugaagaaggugagcaccggcgacagcaugaagcuggagaagagcuucgagacccuggugcagaagaccggcugcaccggcaacggcuuccagggcuacuacgugugccuggugggcagcagcagcgagccccuguacauccccacccuggacgacuacagaagcgccgagauccugagcagaauggccuucgccccccacggcgaggaccacgacguggagaagaacgccaucagcgccaugagaaucgugggcaaggugaccggcaaggcccccagcaccgagagcagcgacaccauccagggcaucgccuucagcggcaacccccuguacaccagcaccggcgugcugaccgccaaggacgaccccguguacaucugggcccccggcaucaucauggagggcaaccacagcgugugcgacaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcuggauccugauccccuucuucagcaugauccugcugaagauccugaucgccuucgccuaccugugcagcaaguacaacaccgacagcaaguucaagauccugaucgagaaggugaagagagaguaccagaagaccaugggcagcauggugugcgaggugugccaguacgagugcgagaccgccaaggagcuggagagccacagaaagagcugccccaucggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggcuucaacuggugccugcugcuggugcuggagcugaucgugugggccgccagcgccgagacccagagccugaacagcggcuggaccgacaccgcccacggcagcggcaucauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucaucgagaaggacuacgaguacgagagcggcuggggcugcaacccccccgacugccccggcgugggcaccggcugcaccgccugcggcguguaccuggacaagcugaagagcgugggcaaggccuucaagaucgugagccugagauacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccaguucggcgaccccggcgacaucaugagcacccccgugggcaugaagugccccgagcugagcggcagcuucagaaagaagugcgccuucgccaccacccccgugugccaguucgacggcaacacccugagcggcuacaagagaaugaucgccaccaaggacagcuuccagagcuucaacgugaccgagccccacaucagcgccagcagccuggaguggaucgaccccgacagcagccugagagaccacaucaacgugaucgugggcagagaccugagcuuccaggaccugagcgagacccccugccagguggaccuggccaccaccagcaucgacggcgccuggggcagcggcgugggcuucaaccuggugugcagcgugagccugaccgagugcagcaccuuccugaccagcaucaaggccugcgacagcgccaugugcuacggcagcaccaccgccaaccugcugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcugguucaccaagagcggcgaguggauccugggcgugcugaacggcaacuggauggugguggccgugcugaucgcccuguucaucuucagcaucuuccuguucacccugugcugccccagaagacccagcuacgccaaggagcacaagcccuga

SEQ ID NO: 8500 - RNA, 3447 nt, Artificial Sequence
  derived and/or modified CDS sequence (opt4) from PUUV(CG17/Baskiria-2001)__AF442614.1__GP
augggcgagcugagccccgugugccuguaccugcugcugcagggccugcugcugugcaacaccggcgccgccagaaaccugaacgagcugaagauggagugcccccacaccaucggccugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggaccacgugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccuga

SEQ ID NO: 8501 - RNA, 3447 nt, Artificial Sequence
  derived and/or modified CDS sequence (opt4) from PUUV(CG215/Omsk)__AF442615.1__GP
augggcaagcugagccccgugugccuguaccugcugcugcagugccugcugcugggcgacagaggcgacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaucaagaacgaccuggccgagaacacccaggccagcagcaccagcuuccagaccaagagcagcgaggugaaccugagaggccugugccugauccccacccuggugguggagaccgccgccagaaccagaaagaccaucgccugcuacgaccugaccugcaaccagaccgugugccagcccaccguguaccugaugggccccauccagaccugcgugaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacgugaugacccugauggugagaugcuuccugaucaucaagaaggugaccagcggcgacagcaugaagaucgagaagaacuucgagacccuggugcagaagaccggcugcaccggcaacaacuuccagggcuacuacaucugccugaucggcagcagcagcgagccccuguacgugcccacccuggacgacuacagaagcgccgaggugcugagcagaauggccuucgccccccacggcgaggaccacgacaucgagaagaacgccgugagcaccaugagaaucgccggcaaggugaccggcagagcccccagcaccgaggccagcgacaccgugcagggcaucgccuucagcggcagcccccuguacaccagcaccggcgugcugaccgccaaggacgaccccguguacaucugggcccccggcaucaucauggagggcaaccacagcagcugcgacaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaucguguacugcaacggcaucaagaaggugauccugaccaagacccuggugaucggccagugcaucuacaccuucaccagcaucuucagccugauccccggcguggcccacagccuggccguggagcugugcgugcccggccugcacggcuggaccaccaugcugcugcugcugaccuucugcuucggcugggugcugauccccuucaucaccaugauccugcugaagauccugaucgccuucgccuaccugugcagcaaguacaacaccgacagcaaguucagaauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcaaguucuucgugggccugguguggugccugcugcuggugauggagcugaucgugugggccgccagcgccgagacccagaaccugaacagcggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugaaguacaccagaaaggugugcauccagcugggcaccgagcagaccugcaagaccguggacagcaacgacugccugaucaccaccagcgugaaggugugcaugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugguggugggcagagaccugagcuuccaggaccugagcgagacccccugccagguggaccugaugaccagcaccaucgacggcgccuggggcagcggcgugggcuucaaccuggugugcaccgugagccugaccgagugcagccccuuccugaccagcaucaaggccugcgacagcgccaugugcuacggcagcaccaccgugaaccuggugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugaucgcccugcugauccugagcauccugauguucacccugugcugccccagaagacccagcuacagaaaggagcacaagcccuga

SEQ ID NO: 8502 - RNA, 3447 nt, Artificial Sequence
  derived and/or modified CDS sequence (opt4) from PUUV(CG222/Omsk)__AF442616.1__GP
augggcaagcugagccccgugugccuguaccugcugcugcagugccugcugcugggcgacagaggcgacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaucaagaacgaccuggccgagaacacccaggccagcagcaccagcuuccagaccaagagcagcgaggugaaccugagaggccugugccugauccccacccuggugguggagaccgccgccagaaccagaaagaccaucgccugcuacgaccugaccugcaaccagaccgugugccagcccaccguguaccugaugggccccauccagaccugcgugaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacgugaugacccugauggugagaugcuuccugaucaucaagaaggugaccagcggcgacagcaugaagaucgagaagaacuucgagacccuggugcagaagaccggcugcaccggcaacaacuuccagggcuacuacaucugccugaucggcagcagcagcgagccccuguacgugcccacccuggacgacuacagaagcgccgaggugcugagcagaauggccuucgccccccacggcgaggaccacgacaucgagaagaacgccgugagcaccaugagaaucgccggcaaggugaccggcagagcccccagcaccgaggccagcgacaccgugcagggcaucgccuucagcggcagcccccuguacaccagcaccggcgugcugaccgccaaggacgaccccguguacaucugggcccccggcaucaucauggagggcaaccacagcagcugcgacaagaagacccugccccugaccuggaccggcuucaucagccugcccggcgagaucgagaagaccacccagugcaccguguucugcacccuggccggccccagagccgacugcgaggccuacagcgagaccggcaucuucaacaucagcagccccaccugccugaucaacagagugcagagauucagaggcgccgagcagcagaucaaguucgugugccagagaguggacauggacaucaucguguacugcaacggcaucaagaaggugauccugaccaagacccuggugaucggccagugcaucuacaccuucaccagcaucuucagccugauccccggcguggcccacagccuggccguggagcugugcgugcccggccugcacggcuggaccaccaugcugcugcugcugaccuucugcuucggcugggugcugauccccuucaucaccaugauccugcugaagauccugaucgccuucgccuaccugugcagcaaguacaacaccgacagcaaguucagaauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcaaguucuucgugggccugguguggugccugcugcuggugauggagcugaucgugugggccgccagcgccgagacccagaaccugaacagcggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugaaguacaccagaaaggugugcauccagcugggcaccgagcagaccugcaagaccguggacagcaacgacugccugaucaccaccagcgugaaggugugcaugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugguggugggcagagaccugagcuuccaggaccugagcgagacccccugccagguggaccugaugaccagcaccaucgacggcgccuggggcagcggcgugggcuucaaccuggugugcaccgugagccugaccgagugcagcgccuuccugaccagcaucaaggccugcgacagcgccaugugcuacggcagcaccaccgugaaccuggugagaggccagaacaccgugcacaucgugggcaagggcggccacagcggcagcaaguucaugugcugccacgacaccaagugcagcagcaccggccugguggccgccgcccccccccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugaucgcccugcugauccugagcauccugauguucacccugugcugccccagaagacccagcuacagaaaggagcacaagcccuga

SEQ ID NO: 8503 - RNA, 3447 nt, Artificial Sequence
  derived and/or modified CDS sequence (opt4) from PUUV(CRF161)__AF367061.1__GP
augggcaagcugagccccgugugccuguaccugcugcugcagugccugcugcugggcgacagaggcgacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaucaagaacgaccugguggagaacacccaggccagcagcaccagcuuccagaccaagagcagcgaggugaaccugagaggccugugccugauccccacccuggugguggagaccgccgccagaaccagaaagaccaucgccugcuacgaccugaccugcaaccagaccgugugccagcccaccguguaccugaugggccccauccagaccugcaucaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacgugaugacccugauggugagaugcuuccugaucaucaagaaggugaccagcggcgacagcaugaagaucgagaagaacuucgagacccuggugcagaagaccggcugcaccggcaacaacuuccagggcuacuacaucugccugaucggcagcagcagcgagccccuguacgugcccacccuggacgacuacagaagcgccgaggugcugagcagaauggccuucgccccccacggcgaggaccacgacaucgagaagaacgccgugagcaccaugagaaucgccggcaagguggccggcagagcccccagcaccgaggccagcgacaccgugcagggcaucgccuucagcggcagcccccuguacaccagcaccggcgugcugaccgccaaggacgaccccguguacaucugggcccccggcaucaucauggagggcaaccacagcagcugcgacaagaagacccugccccugaccuggaccggcuucaucagccugcccggcgagauccagaagaccacccagugcaccguguucugcacccuggccggccccagagccgacugccaggccuacagcgagaccggcaucuucaacaucagcagccccaccugccugaucaacagagugcagagauucagaggcgccgagcagcagaucaaguucgugugccagagaguggacauggacaucaucguguacugcaacggcaucaagaaggugauccugaccaagacccuggugaucggccagugcaucuacaccuucaccagcaucuucagccugauccccggcguggcccacagccuggccguggagcugugcgugcccggccugcacggcuggaccaccaugcugcugcugcugaccuucugcuucggcugggugcugauccccuucaucaccaugauccugcugaagauccugaucgccuucgccuaccugugcagcaaguacaacaccgacagcaaguucagaauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcaaguucuucgugggccugguguggugccugcugcuggugauggagcugaucgugugggccgccagcgccgagacccagaaccugaacagcggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugaaguacaccagaaaggugugcauccagcugggcaccgagcagaccugcaagaccguggacagcaacgacugccugaucaccaccagcgugaaggugugcaugaucggcaccaucagcaaguuccagcccagcgacacccugcugauccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugguggugggcagagaccugagcuuccaggaccugagcgagacccccugccagguggaccugaugaccagcaccaucgacggcgccuggggcagcggcgugggcuucaaccuggugugcaccgugagccugaccgagugcagcgccuuccugaccagcaucaaggccugcgacagcgccaugugcuacggcagcaccaccgccaaccuggugaagggccagaacaccgugcacauggugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugaucgcccugcugauccugagcauccugauguucacccugugcugccccagaagacccagcuacagaaaggagcacaagcccuga

SEQ ID NO: 8504 - RNA, 3447 nt, Artificial Sequence
  derived and/or modified CDS sequence (opt4) from PUUV(CRF308/Omsk)__AF442617.1__GP
augggcaagcugagccccgugugccuguaccugcugcugcagugccugcugcugggcgacagaggcgacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaucaagaacgaccuggccgagaacacccaggccagcagcaccagcuuccagaccaagagcagcgaggugaaccugagaggccugugccugauccccacccuggugguggagaccgccgccagaaccagaaagaccaucgccugcuacgaccugaccugcaaccagaccgugugccagcccaccguguaccugaugggccccauccagaccugcaucaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacgugaugacccugauggugagaugcuuccugaucaucaagaaggugaccagcggcgacagcaugaagaucgagaagaacuucgagacccuggugcagaagaccggcugcaccggcaacaacuuccagggcuacuacaucugccugaucggcagcagcagcgagccccuguacgugcccacccuggacgacuacagaagcgccgaggugcugagcagaauggccuucgccccccacggcgaggaccacgacaucgagaagaacgccgugagcaccaugagaaucgccggcaagguggccggcagagcccccagcaccgaggccagcgacaccgugcagggcaucgccuucagcggcagcccccuguacaccagcaccggcgugcugaccgccaaggacgaccccguguacaucugggcccccggcaucaucauggagggcaaccacagcagcugcgacaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaucguguacugcaacggcaucaagaaggugauccugaccaagacccuggugaucggccagugcaucuacaccuucaccagcaucuucagccugauccccggcaucgcccacagccuggccguggagcugugcgugcccggccugcacggcuggaccaccaugcugcugcugcugaccuucugcuucggcugggugcugauccccuucaucaccaugauccugcugaagauccugaucgccuucgccuaccugugcagcaaguacaacaccgacagcaaguucagaauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcaaguucuucgugggccugguguggugccugcugcuggugauggagcugaucgugugggccgccagcgccgagacccagaaccugaacagcggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugaaguacaccagaaaggugugcauccagcugggcaccgagcagaccugcaagaccguggacagcaacgacugccugaucaccaccagcgugaaggugugcaugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugguggugggcagagaccugagcuuccaggaccugagcgagacccccugccagguggaccugaugaccagcaccaucgacggcgccuggggcagcggcgugggcuucaaccuggugugcaccgugagccugaccgagugcagcgccuuccugaccagcaucaaggccugcgacagcgccaugugcuacggcagcaccaccgccaaccuggugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugaucgcccugcugauccugagcauccugauguucacccugugcugccccagaagacccagcuacagaaaggagcacaagcccuga

SEQ ID NO: 8505 - RNA, 3447 nt, Artificial Sequence
  derived and/or modified CDS sequence (opt4) from PUUV(Mu/07/1219)__KJ994777.1__GP
auggagaagaucauccccgugugccuguaccugcccuuccugugccugcugcuguggagcagaggcgacaccagaaaccugaacgagcugaagauggagugcccccacaccaucggccugggccagggccuggugaucggcagcaucgagcugccccccgugccccugauccagguggagagccugaagcuggagagcagcugcaacuucgaccugcacaccagcaccagcagccagcaggccuucaccaaguggaccugggaggugaagagcgaccuggccgagaacacccaggccagcagcaccagcuuccagaccaagagcagcgaggugaaccugagaggccugugccuggugcccccccuggugaucgagaccgccgccagaaccagaaagaccaucgccugcuucgaccugagcugcaaccagaccaccugccagcccaccguguuccugaugggccccauccagaccugcaucaccaccaagagcugccugcugggccugggcgaccagagaauccaggugaacuacgagaagaccuacugcgugagcggccagcugaucgagggcaucugcuucaaccccgugcacaccauggcccugagccagcccagccacaccuacgacaucgugaccgugauggugagaugcuuccugaucgugaagaaggugaccaccggcgacagcaugaagaucgagaagagcuucgagacccuggugcagaagaccggcugcaccgacaacggcuuccagggcuacuacgugugccugaucggcagcagcagcgagccccuguacauccccacccuggacgacuacagaagcgccgaggugcugagcagaauggccuucgccccccacggcgaggaccacgacaucgagaagaacgccaucagcgccaugagaaucgugggcaaggugaccggcaaggcccccagcaccgagagcagcgacaccgugcagggcaucgccuucagcggcaacccccuguacaccagcaccggcgugcugaccgccaaggacgaccccguguacgugugggcccccggcaucaugauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcuggauccugauccccuucuucgccaugauccugcugaaggugcugaucgcccuggccuaccugugcagcaaguacaacaccgacagcaaguucaaggugcugaucgagaaggugaagaaggaguaccagaagaccaugggcagcauggugugcgaggugugccaguacgagugcgagaccgccaaggagcuggagagccacagaaagagcugccccaugggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggcuucaucuggugccugcugcuggugcuggagcugaucgugugggccgccagcgccgagacccagaaccugaacagcggcuggaccgacaccgcccacggcagcggcgugauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucguggagaaggacuacgaguacgagagcggcuggggcugcaaccccgccgacugccccggcgugggcaccggcugcaccgccugcggcguguaccuggacaagcugaagagcgugggcaaggccuucaagaucgugagccugagauacaccagaaaggccugcauccagcugggcaccgagcagaccugcaagaacguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccaguucggcgaccccggcgacaucaugagcacccccgugggcaugaagugccccgagcugagcggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcagccuggaguggaucgaccccgacagcagccugagagaccacaucaacgugaucgugggcagagaccugagcuuccaggaccugagcgagacccccugccagguggaccugaccaccaccagcaucgacggcgccuggggcagcggcgugggcuucaaccugaucugcagcgugagccugaccgagugcagcaccuuccugaccagcaucaaggccugcgacagcgccaugugcuacggcagcaccaccgccaaccuggugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcugguucaccaagagcggcgaguggauccugggcgugcugaacggcaacuggauggugguggccgugcugguggcccuguucauccugagcaucuuccuguucacccugugcugccccagaagacccagcuacgccaaggagcacaagcccuga

SEQ ID NO: 8506 - RNA, 3447 nt, Artificial Sequence
  derived and/or modified CDS sequence (opt4) from PUUV(Puu/Kazan)__Z84205.1__GP
augggcaagcugagccccgugugccuguaccugcugcugcagggccugcugcuguucaacaccggcaccgccagaaaccugaacgagcugaagauggagugcccccacaccaucggccugggccagggccugguggugggcagcguggagcugccccccgugcccauccagcagguggagacccugaagcuggagagcagcugcaacuucgaccugcacaccagcaccgccggccagcaggccuucaccaaguggaccugggagaucaagggcgaccuggccgagaacacccaggccagcagcaccagcuuccagaccaagagcagcgaggugaaccugagaggccugugccugauccccacccuggugaucgagaccgccgccagaaugagaaagaccaucgccugcuacgaccugagcugcaaccagaccgugugccagcccaccguguaccugaugggccccauccagaccugcaucaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacaucgugaccaugauggugagaugcuuccuggugaucaagaaggugaccagcggcgacagcaugaagaucgagaagaacuucgagacccuggugcagaagaacggcugcaccgccaacagcuuccagggcuacuacaucugccugaucggcagcagcagcgagccccuguacgugcccacccuggacgacuacagaagcgccgaggugcugagcagaauggccuucgccccccacggcgaggaccacgacguggagaagaacgccaucagcgcccugagaaucgccggcaaggugaccggcaaggcccccagcaccgagagcagcgacaccgugcagggcguggccuucagcggcagcccccuguacaccagcaccggcgugcugaccgccaaggacgaccccguguacaucugggcccccggcaucaucauggagggcaaccacagcgugugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccaccaucaccaugauccugcugaagauccugaucgccuucgccuaccugugcagcaaguacaacaccgacagcaaguucagaauccugaucgagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagaauccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaacauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcgccuaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgaccugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugaucgugagcagagaccugagcuuccaggaccugagcgagacccccugccagaucgaccugagcaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcaccaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugaucgcccugcugauccugagcauccugcuguucacccugugcugccccagaagacccagcuacagaaaggagcacaagcccuga

SEQ ID NO: 8507 - RNA, 3447 nt, Artificial Sequence
  derived and/or modified CDS sequence (opt4) from PUUV(PUUV/Ardennes/Mg156/2011)__KT247603.1__GP
augggcaagaucauccccgugugccuguaccugcuguuccugugccugcugcugugggacagaggcgacaccagaaaccugaacgagcugaagauggagugcccccacaccaucggccugggccagggccuggugaucggcagcguggagcugccccccgugccccugacccagguggagagccugaagcuggagagcagcugcaacuucgaccugcacaccagcaccagcagccagcagagcuucaccaaguggaccugggagaugaagguggaccuggccgagaacacccaggccagcagcaccagcuuccagaccaagagcagcgagaucaaccugagaggccugugccuggugcccccccuggugaucgagaccgccgccagaaccagaaagaccaucgccugcuucgaccugagcugcaaccagaccgccugccagcccaccguguuccugaucggccccauccagaccugcaucaccaccaagagcugccugcugggccugggcgaccagagaauccaggugaacuacgagaagaccuacugcgugagcggccagcugguggagggcaucugcuucaaccccgugcacaccauggcccugagccagcccagccacaccuacgacaucgugaccgugauggugagaugcuuccugaucgugaagaaggugagcaccggcgacagcaugaagcuggagaagagcuucgagacccuggugcagaagaccggcugcaccggcaacggcuuccagggcuacuacgugugccugaucggcagcagcagcgagccccuguacauccccacccuggacgacuacagaagcgccgaggugcugagcagaauggccuucgccccccacggcgaggaccacgacaucgagaagaacgccaucagcgccaugagaaucgugggcaaggugaccggcaaggcccccagcaccgagagcagcgacaccgugcagggcaucgccuucagcggcaacccccuguacaccagcaccggcgugcugaccgccaaggacgaccccaucuacaucugggcccccggcaucaucauggagggcaaccacagcgugugcgacaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcuggauccugauccccuucuucagcaugauccugcugaagauccugaucgccuucgccuaccugugcagcaaguacaacaccgacagcaaguucaagauccugaucgagaaggugaagaaggaguaccagaagaccaugggcagcauggugugcgaggugugccaguacgagugcgagaccgccaaggagcuggagagccacagaaagagcugccccaugggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggcuucaucuggugcuuccugcuggugcuggagcugaucgugugggccgccagcgccgagacccagaaccugaacagcggcuggaccgacaccgcccacggcagcggcaucauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucguggagaaggacuacgaguacgagagcggcuggggcugcaacccccccgacugccccggcgugggcaccggcugcaccgccugcggcguguaccuggacaagcugaagagcgugggcaaggccuucaagaucgugagccugagauacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccaguucggcgaccccggcgacaucaugagcacccccgugggcaugaagugccccgagcugagcggcagcuucagaaagaagugcgccuucgccaccacccccgugugccaguucgacggcaacacccugagcggcuacaagagaaugaucgccaccaaggacagcuuccagagcuucaacgugaccgagccccacaucagcgccagcagccuggaguggaucgaccccgacagcagccugagagaccacaucaacgugaucgugggcagagaccugagcuuccaggaccugagcgagacccccugccagguggaccuggccaccagcagcaucgacggcgccuggggcagcggcgugggcuucaaccuggugugcagcgugagccugaccgagugcagcaccuuccugaccagcaucaaggccugcgacagcgccaugugcuacggcagcaccaccgccaaccugcugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcugguucaccaagagcggcgaguggauccugggcgugcugaacggcaacuggauggugguggccgugcugguggcccuguucauccugagcaucuuccuguucacccugugcugccccagaagacccagcuacgccaaggagcacaagcccuga

SEQ ID NO: 8508 - RNA, 3447 nt, Artificial Sequence
  derived and/or modified CDS sequence (opt4) from PUUV(PUUV/Ardennes/Mg75/2011)__KT247602.1__GP
augggcaagaucauccccgugugccuguaccugcuguuccugugccugcugcugugggacagaggcgacaccagaaaccugaacgagcugaagauggagugcccccacaccaucggccugggccagggccuggugaucggcagcguggagcugccccccgugccccugacccagguggagagccugaagcuggagagcagcugcaacuucgaccugcacaccagcaccagcagccagcagagcuucaccaaguggaccugggagaugaagguggaccuggccgagaacacccaggccagcagcaccagcuuccagaccaagagcagcgagaucaaccugagaggccugugccuggugcccccccuggugaucgagaccgccgccagaaccagaaagaccaucgccugcuucgaccugagcugcaaccagaccgccugccagcccaccguguuccugaucggccccauccagaccugcaucaccaccaagagcugccugcugggccugggcgaccagagaauccaggugaacuacgagaagaccuacugcgugagcggccagcugguggagggcaucugcuucaaccccgugcacaccauggcccugagccagcccagccacaccuacgacaucgugaccgugauggugagaugcuuccugaucgugaagaaggugagcaccggcgacagcaugaagcuggagaagagcuucgagacccuggugcagaagaccggcugcaccggcaacggcuuccagggcuacuacgugugccugaucggcagcagcagcgagccccuguacauccccacccuggacgacuacagaagcgccgaggugcugagcagaauggccuucgccccccacggcgaggaccacgacaucgagaagaacgccaucagcgccaugagaaucgugggcaaggugaccggcaaggcccccagcaccgagagcagcgacaccgugcagggcaucgccuucagcggcaacccccuguacaccagcaccggcgugcugaccgccaaggacgaccccaucuacaucugggcccccggcaucaucauggagggcaaccacagcgugugcgacaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcuggauccugauccccuucuucagcaugauccugcugaagauccugaucgccuucgccuaccugugcagcaaguacaacaccgacagcaaguucaagauccugaucgagaaggugaagaaggaguaccagaagaccaugggcagcauggugugcgaggugugccaguacgagugcgagaccgccaaggagcuggagagccacagaaagagcugccccaugggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggcuucaucuggugcuuccugcuggugcuggagcugaucgugugggccgccagcgccgagacccagaaccugaacagcggcuggaccgacaccgcccacggcagcggcaucauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucguggagaaggacuacgaguacgagagcggcuggggcugcaacccccccgacugccccggcgugggcaccggcugcaccgccugcggcguguaccuggacaagcugaagagcgugggcaaggccuucaagaucgugagccugagauacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccacuucggcgaccccggcgacaucaugagcacccccgugagcaugaagugccccgagcugagcggcagcuucagaaagaagugcgccuucgccaccacccccgugugccaguucgacggcaacacccugagcggcuacaagagaaugaucgccaccaaggacagcuuccagagcuucaacgugaccgagccccacaucagcgccagcagccuggaguggaucgaccccgacagcagccugagagaccacaucaacgugaucgugggcagagaccugagcuuccaggaccugagcgagacccccugccagguggaccuggccaccagcagcaucgacggcgccuggggcagcggcgugggcuucaaccuggugugcagcgugagccugaccgagugcagcaccuuccugaccagcaucaaggccugcgacagcgccaugugcuacggcagcaccaccgccaaccugcugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcugguucaccaagagcggcgaguggauccugggcgugcugaacggcaacuggauggugguggccgugcugguggcccuguucauccugagcaucuuccuguucacccugugcugccccagaagacccagcuacgccaaggagcacaagcccuga

SEQ ID NO: 8509 - RNA, 3447 nt, Artificial Sequence
  derived and/or modified CDS sequence (opt4) from PUUV(PUUV/Jura/Mg2/2010)__KT247598.1__GP
augggcaagaucauccccgugugccuguaccugcuguuccugugccugcugcuguggaacagaggcgacaccagaaaccugaacgagcugaagauggagugcccccacaccaucggccugggccagggccuggugaucggcagcguggagcugccccccgugccccugacccagguggagagccugaagcuggagagcagcugcaacuucgaccugcacaccagcaccagcagccagcagagcuucaccaaguggaccugggagaugaagagcgaccuggccgagaacacccaggccagcagcaccagcuuccagaccaagagcagcgagaucaaccugagaggccugugccuggugcccccccuggugaucgagaccgccgccagaaccagaaagaccaucgccugcuucgaccugagcugcaaccagaccgccugccagcccaccguguuccugaucggccccauccagaccugccugaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacaucgugaccgugauggugagaugcuuccugaucgugaagaaggugagcaccggcgacagcaugaagaucgagaagagcuucgagacccuggugcagaagaccggcugcaccggcaacggcuuccagggcuacuacgugugccugaucggcagcagcagcgagccccuguacauccccacccuggacgacuacagaagcgccgaggugcugagcagaauggccuucgccccccacggcgaggaccacgacaucgagaagaacgccaucagcgccaugagaaucgugggcaaggugaccggcaaggcccccagcaccgagagcagcgacaccgugcagggcaucgccuucagcggcaacccccuguacaccagcaccggcgugcugaccgccaaggacgaccccaucuacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcuggauccugauccccuucaccgccaugcugcugcugaagauccugaucgccuucgccuaccugugcagcaaguacaacaccgacagcaaguucaagauccugaucgagaaggugaagaaggaguaccagaagaccaugggcagcauggugugcgaggugugccaguacgagugcgagaccgccaaggagcuggagagccacagaaagagcugccccaugggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggccugguguggugcuuccugcuggugcuggagcugaucaucugggccgccagcgccgagacccagaaccugaacagcggcuggaccgacaccgcccacggcagcggcgugauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucguggagaaggacuacgaguacgagagcggcuggggcugcaacccccccgacugccccggcgugggcaccggcugcaccgccugcggcguguaccuggacaagcugaagagcgugggcaaggccuucagaaucgugagccugaaguacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccaguucggcgaccccagagacaucaugagcacccccgugggcaugagaugccccgagcugagcggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcagccuggaguggaucgaccccgacagcagccugagagaccacaucaacgugaucgugggcagagaccugagcuuccaggaccugagcgagacccccugccagguggaccugaccaccaccagcaucgacggcgccuggggcagcggcgugggcuucaaccugaucugcagcgugagccugaccgagugcagcaccuuccugaccagcaucaaggccugcgacagcgccaugugcuacggcagcaccaccgccaaccugaugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcugguucaccaagagcggcgaguggauccugggcgugcugaacggcaacuggauggugguggccgugcugguggugcuguucauccugagcaucuuccuguucacccugugcugccccagaagacccagcuacgccaaggagcacaagcccuga

SEQ ID NO: 8510 - RNA, 3447 nt, Artificial Sequence
  derived and/or modified CDS sequence (opt4) from PUUV(PUUV/Jura/Mg214/2010)__KT247599.1__GP
augggcaagaucauccccgugugccuguaccugcuguuccugugccugcugcuguggaacagaggcgacaccagaaaccugaacgagcugaagauggagugcccccacaccaucggccugggccagggccuggugaucggcagcguggagcugccccccgugccccugacccagguggagagccugaagcuggagagcagcugcaacuucgaccugcacaccagcaccagcagccagcagagcuucaccaaguggaccugggagaugaagagcgaccuggccgagaacacccaggccagcagcaccagcuuccagaccaagagcagcgagaucaaccugagaggccugugccuggugcccccccuggugaucgagaccgccgccagaaccagaaagaccaucgccugcuucgaccugagcugcaaccagaccgccugccagcccaccguguuccugaucggccccauccagaccugccugaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacaucgugaccgugauggugagaugcuuccugaucgugaagaaggugagcaccggcgacagcaugaagaucgagaagagcuucgagacccuggugcagaagaccggcugcaccggcaacggcuuccagggcuacuacgugugccugaucggcagcagcagcgagccccuguacauccccacccuggacgacuacagaagcgccgaggugcugagcagaauggcccuggccccccacggcgaggaccacgacaucgagaagaacgccaucagcgccaugagaaucgugggcaaggugaccggcaaggcccccagcaccgagagcagcgacaccgugcagggcaucgccuucagcggcaacccccuguacaccagcaccggcgugcugaccgccaaggacgaccccaucuacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcuggauccugauccccuucaccgccaugcugcugcugaagauccugaucgccuucgccuaccugugcagcaaguacaacaccgacagcaaguucaagauccugaucgagaaggugaagaaggaguaccacaagagcaugggcagcauggugugcgaggugugccaguacgagugcgagaccgccaaggagcuggagagccacagaaagagcugccccaugggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggccugguguggugcuuccugcuggugcuggagcugaucaucugggccgccagcgccgagacccagaaccugaacagcggcuggaccgacaccgcccacggcagcggcgugauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucguggagaaggacuacgaguacgagagcggcuggggcugcaacccccccgacugccccggcgugggcaccggcugcaccgccugcggcguguaccuggacaagcugaagagcgugggcaaggccuucagaaucgugagccugaaguacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccaguucggcgaccccggcgacaucaugagcacccccgugggcaugagaugccccgagcugagcggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcagccuggaguggaucgaccccgacagcagccugagagaccacaucaacgugaucgugggcagagaccugagcuuccaggaccugagcgagacccccugccagguggaccugaccaccaccagcaucgacggcgccuggggcagcggcgugggcuucaaccugaucugcagcgugagccugaccgagugcagcaccuuccugaccagcaucaaggccugcgacagcgccaugugcuacggcagcaccaccgccaaccugaugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcugguucaccaagagcggcgaguggauccugggcgugcugaacggcaacuggauggugguggccgugcugguggugcuguucauccugagcaucuuccuguucacccugugcugccccagaagacccagcuacgccaaggagcacaagcccuga

SEQ ID NO: 8511 - RNA, 3447 nt, Artificial Sequence
  derived and/or modified CDS sequence (opt4) from PUUV(PUUV/Orleans/Mg23/2010)__KT247600.1__GP
augggcaagaucauccccgugugccuguaccugcuguucagaugccugcugcugugggacagaggcaacgccagaaaccugaacgagcugaagauggagugcccccacaccaucggccugggccagggccuggugaucggcagcguggagcugccccccgugccccugacccagaucgagagccugaagcuggagagcagcugcaacuucgaccugcacaccagcaccagcagccagcagagcuucaccaaguggaccugggagaucaagagcgaccuggccgagaacacccaggccagcagcaccagcuuccagaccaagagcagcgaggugaaccugagaggccugugccuggugcccccccuggugaucgagaccgccgccagaaccagaaagaccaucgccugcuucgaccugagcugcaaccagaccgccugccagcccaccguguuccugaucggccccauccagaccugcaucaccaccaagagcugccugcugggccugggcgaccagagaauccaggugaacuacgagaagaccuacugcgugagcggccagcugaucgagggcaucugcuucaaccccgugcacaccauggcccugagccagcccagccacaccuacgacguggugaccgugauggugagaugcuuccugaucgugaagaaggugagcaccggcgacagcaugaagaucgagaagagcuucgagacccuggugcagaagaccggcugcaccggcaacggcuuccagggcuacuacgugugccugaucggcagcagcagcgagccccuguacauccccacccuggacgacuacagaagcgccgaggugcugagcagaauggccuucgccccccacggcgaggaccacgacaucgagaagaacgccaucagcgccaugagaaucgugggcaaggugaccggcaaggcccccagcaccgaggccagcgacaccgugcagggcaucgccuucagcggcaacccccuguacaccagcaccggcgugcugaccgccaaggacgaccccaucuacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagaccuucaucaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccuucuucagcaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugccccaugggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggcuucaucuggugcuuccugcuggugcuggagcugaucaucugggccgccagcgccgagacccagaaccugaacagcggcuggaccgacaccgcccacggcagcggcgugauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucaucgagaaggacuacgaguacgagagcggcuggggcugcaacccccccgacugccccggcgugggcaccggcugcaccgccugcggcguguaccuggacaagcugaagagcgugggcaaggccuucaagaucgugagccugagauacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccacuucggcgaccccggcgacaucaugagcacccccgccggcaugaagugccccgagcugagcggcagcuucaccaagaagugcgccuucgcccccacccccgugugccaguucgacggcgacaccaccagcggcuacaagaagaugaucgccaccaaggacagcuuccagagcuucaacgugaccgagccccacaucagcgccagcagccuggaguggaucgaccccgacagaagccugagagaccacaucaacgugaucgugggcagagaccugagcuuccaggaccugagcgagacccccugccagguggaccugaccaccaccagcaucgacggcgccuggggcagcggcgugggcuucaaccugaucugcagcgugagccugaccgagugcagcaccuuccugaccagcaucaaggccugcgacagcgccaugugcuacggcagcaccaccgccaaccugcugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcuggcugaccaagagcggcgaguggauccugggcgugcugaacggcaacuggauggugguggccgugcugguggcccuguucaucuucagcaucuuccuguucacccugugcugccccagaagacccagcuacgccaaggagcacaagcccuga

SEQ ID NO: 8512 - RNA, 3447 nt, Artificial Sequence
  derived and/or modified CDS sequence (opt4) from PUUV(PUUV/Orleans/Mg29/2010)__KT247601.1__GP
augggcaagaucauccccgugugccuguaccugcuguucagaugccugcugcugugggacagaggcaacgccagaaaccugaacgagcugaagauggagugcccccacaccaucggccugggccagggccuggugaucggcagcguggagcugccccccgugccccugacccagaucgagagccugaagcuggagagcagcugcaacuucgaccugcacaccagcaccagcagccagcagagcuucaccaaguggaccugggagaucaagagcgaccuggccgagaacacccaggccagcagcaccagcuuccagaccaagagcagcgaggugaaccugagaggccugugccuggugcccccccuggugaucgagaccgccgccagaaccagaaagaccaucgccugcuucgaccugagcugcaaccagaccgccugccagcccaccguguuccugaucggccccauccagaccugcaucaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacaucgugaccgugauggugagaugcuuccugaucgugaagaaggugagcaccggcgacagcaugaagaucgagaagagcuucgagacccuggugcagaagaccggcugcaccggcaacggcuuccagggcuacuacgugugccugaucggcagcagcagcgagccccuguacauccccacccuggacgacuacagaagcgccgaggugcugagcagaauggccuucgccccccacggcgaggaccacgacaucgagaagaacgccaucagcgccaugagaaucgugggcaaggugaccggcaaggcccccagcaccgaggccagcgacaccgugcagggcaucgccuucagcggcaacccccuguacaccagcaccggcgugcugaccgccaaggacgaccccaucuacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagaccuucaucaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccuucuucagcaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugccccaugggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggcuucaucuggugcuuccugcuggugcuggagcugaucaucugggccgccagcgccgagacccagaaccugaacagcggcuggaccgacaccgcccacggcagcggcgugauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucaucgagaaggacuacgaguacgagagcggcuggggcugcaacccccccgacugccccggcgugggcaccggcugcaccgccugcggcguguaccuggacaagcugaagagcgugggcaaggccuucaagaucgugagccugagauacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccacuucggcgaccccggcgacaucaugagcacccccgccggcaugaagugccccgagcugagcggcagcuucagaaagaagugcgccuucgcccccacccccgugugccacuucgacggcaagaccaucagcggcuacaagagaaugaucgccaccaaggacagcuuccagagcuucaacgugaccgagccccacaucagcgccagcagccuggaguggaucgaccccgacagcagccugagagaccacaucaacgugaucgugggcagagaccugagcuuccaggaccugagcgagacccccugccagguggaccugaccaccaccagcaucgacggcgccuggggcagcggcgugggcuucaaccugaucugcagcgugagccugaccgagugcagcaccuuccugaccagcaucaaggccugcgacagcgccaugugcuacggcagcaccaccgccaaccugcugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcuggcugaccaagagcggcgaguggauccugggcgugcugaacggcaacuggauggugguggccgugcugguggcccuguucaucuucagcaucuuccuguucacccugugcugccccagaagacccagcuacgccaaggagcacaagcccuga

SEQ ID NO: 8513 - RNA, 3447 nt, Artificial Sequence
  derived and/or modified CDS sequence (opt4) from PUUV(Vranica)__U14136.1__GP
augggcaagcugagccccgugugccuguaccuguuccugcagugccugcugcuguggaacagaggcagcgccagaaaccugaacgagcugaagauggagugcccccacaccaucggccugggccagggccuggugaucggcagcguggagcugccccccgugcccauccagcagguggagagccugaagcuggagagcagcugcaacuucgaccugcacaccagcaccgccacccagcagagcuucaccaaguggaccugggagaugaaggacgaccuggccgagaacacccaggccagcagcaccagcuuccagaccaagagcagcgaggugaaccugagaggccugugccugauccccccccuggugguggagaccgccagcagaaccagaaagaccaucgccugcuucgacaucagcugcaaccagaccgugugccagcccaccguguaccuggugggccccauccagaccugcaucaccaccaagagcugccugcugggccugggcgaccagagaauccaggugaacuacgagaagaccuacugcgugagcggccagcugaucgagggcgugugcuucaaccccgugcacaccagagcccugagccagcccagccacaccuacgacaucgugaccaugauggugagaugcuuccugguggugaagaaggugaccagcggcgacagcaugaagaucgagaagaacuucgagacccuggugcagaagaccgacugcaacgccaacggcuuccagggcuacuacaucugccuggugggcagcagcagcgagccccuguacgugcccacccuggacgacuacagaagcgccgaggugcugagcagaauggccuucgccccccacggcgaggaccacgacguggagagaaacgccgugagcgcccugagaaucgugggcaaggugaccggcaaggcccccagcaccgaggccagcgacaccgugcagggcaucgccuucagcggcagcccccuguacaccagcaccggcgugcugaccgccaaggacaaccccguguacaucuggagccccggcaucaucauggagggcaaccacagcgugugcgagaagaagacccugccccugaccuggaccggcuucaucccccugcccggcgagaucgagaagaccccccagugcaccguguucugcacccuggccggccccggcgccgacugcgaggccuacagcgagaccggcaucuucaacaucagcagccccaccugccugcugaacagagugcagagauucagaggcgccgagcagcagaucaaguucgugugccagagaguggacauggacaucaccguguacugcaacggcaugaagaaggugauccugaccaagacccuggugaucggccagugcaucuacaccuucaccagcaucuucagccugauccccggcaucgcccacagccuggccguggagcugugcgugcccggccugcacggcugggccaccgugcugcugcugcugaccuucugcuucggcuggauccugauccccuucaucgccaugauccugcugaagauccugaucgccuucgccuaccugugcagcaaguacaacaccgacagcaaguucaagauccugaucgagaaggugaagaaggaguaccagaagaccaugggcagcauggugugcgaggugugccaguacgagugcgagaccgccaaggagcuggagagccacagaaagagcugccccaucggcagcugccccuacugccugaaccccagcgaggccaccaccagcgcccugcaggcccacuucaaggugugcaagcugaccagcagauuccaggacaaccugagaaagagccuggccgccuacgagcccaagcagggcugcuacagaacccugagccuguucagauacagaagcagauucuucgugggcuucaucuggugcauccugcuggugcuggagcuggugaucugggccgccagcgccgagacccagaaccugaacagcggcuggaccgacaccgcccacggcagcggcguggugcccaugagaaccgaccuggagcuggacuucagccugcccagcagcgccagcuacaccuacagaagacagcugcagaaccccgccaacgagcacgagaagauccccuuccaccugcagaucagcaagcaggugauccacgccgagauccagcaccugggccacuggauggacgccaccuucaaccugaagaccgccuuccacugcuacggccugugcgagaaguacgccuaccccuggcagaccgccggcugcuucuucgagaaggacuacgaguucgagagcggcuggggcugcaacccccccgacugccccggcaucggcaccggcugcaccgccugcggcguguaccuggacaagcugaagagcgugggcaagguguucaagaucaucagccugagauacaccagaaaggccugcauccagcugggcaccgagcagaccugcaagagcguggacagcaacgacugccuggugaccaccagcaucaaggugugccugaucggcaccgugagcaaguuccagcccagcgacacccugcuguuccugggcccccuggagcagggcggccugaucuucaagcaguggugcaccaccaccugccaguucggcgaccccggcgacaucaugagcacccugaccggcaugaagugccccgagcugaacggcagcuucagaaagaagugcgccuucgccaccacccccgugugccaguucgacggcaacaccaucagcggcuacaagagaaugauggccaccaaggacagcuuccagagcuucaacgugaccgagccccacaucagcaccagcgcccuggaguggaucgaccccgacagcagccugagagaccacaucaacgugguggugagcagagaccugagcuuccaggaccugagcgagacccccugccagguggaccugaccaccagcagcaucgacggcgccuggggcagcggcgugggcuucaaccuggugugcaccgugagccugaccgagugccccaccuuccugaccagcaucaaggccugcgacagcgccaugugcuacggcagcaccaccaccaaccuggugagaggccagaacaccgugcacaucgugggcaagggcggccacagcggcagcaaguucaugugcugccacgacaccaagugcagcagcaccggccugaucgccgccgccccccaccuggacagagugaccggcuucaaccaggccgacagcgacaagaucuucgacgacggcgcccccggcugcggcaugagcugcugguucaagaagagcggcgaguggauccugggcgugcugaacggcaacuggcuggugguggccgugcugaucgcccuguucauccugagcaucuuccuguucacccugugcugccccagaagacccaccuacaccaaggagcacaagcccuga

SEQ ID NO: 8514 - RNA, 3447 nt, Artificial Sequence
  derived and/or modified CDS sequence (opt4) from PUUV(CG1820/POR)__KT885051.1__GP
augggcgagcugagccccgugugccuguaccugcugcugcagggccugcugcugugcaacaccggcgccgccagaaaccugaacgagcugaagauggagugcccccacaccaucagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccuga

SEQ ID NO: 8515 - RNA, 3447 nt, Artificial Sequence
  derived and/or modified CDS sequence (opt4) from PUUV(DTK/Ufa-97)__AB297666.2__GP
augggcgagcugagccccgugugccuguaccugcugcugcagggccugcugcugugcaacaccggcgccgccagaaaccugaacgagcugaagauggagugcccccacaccgugagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccuga

SEQ ID NO: 8516 - RNA, 3447 nt, Artificial Sequence
  derived and/or modified CDS sequence (opt4) from PUUV(PUU/Cg-Erft)__AJ238778.1__GP
augggcaagaucauccccgugugccuguaccugcuguuccugugccugcugcuguggaacagaggcgacgccagaaaccugaacgagcugaagaucgagugcccccacaccaucggccugggccagggccuggugaucggcagcguggagcugccccccgugccccugacccagguggagagccugaagcuggagagcagcugcaacuucgaccugcacaccagcaccagcagccagcagcccuucaccaaguggaccugggagaugaagagcgaccuggccgagaacacccaggccagcagcaccagcuuccagaccaagagcagcgagaucaaccugagaggccugugccuggugcccccccuggugaucgagaccgccgccagaaccagaaagaccaucgccugcuucgaccugagcugcaaccagaccgccugccagcccaccguguuccugaucggccccauccagaccugcaucaccaccaagagcugccugcugggccugggcgaccagagaauccaggugaacuacgagaagaccuacugcgugagcggccagcugguggagggcgugugcuucaaccccgugcacaccauggcccugagccagcccagccacaccuacgacaucgugaccgugauggugagaugcuuccugaucgccaagaaggugagcaccggcgacagcaugaagcuggagaagagcuucgagacccuggugcagaagaccagcugcaccggcaacggcuuccagggcuacuacaucugccuggugggcagcagcagcgagccccuguacauccccacccuggacgacuacagaagcgccgaggugcugagcagaauggccuucgccccccacggcgaggaccacgacguggagaagaacgccaucagcgccaugagaaucaucggcaaggugaccggcaaggcccccagcaccgagagcagcgacaccauccagggcguggccuucagcggcaacccccuguacaccagcaccggcgugcugaccgccaaggacgaccccguguacaucugggcccccggcaucaucauggagggcaaccacagcgugugcgacaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucaucugccagagaguggacauggacaucaccguguacugcaacggccugaagaaggugauccugaccaagacccugaucaucggccagugcaucuacaccuucaccagcaucuucagccugauccccggcguggcccacagccuggccguggagcugugcgugcccggccugcacggcugggccaccaugcugcugcugcugaccuucugcuucggcuggauccugauccccuucuucagcaugauccugcugaagauccugaucgccuucgccuaccugugcagcaaguacaacaccgacagcaaguucaagauccugaucgagaaggugaagaaggaguaccagaagaccaugggcagcauggugugcgaggugugccacuacgagugcgagaccgccaaggagcuggagagccacagaaagagcugccccaugggcagcugccccuacugccugaaccccgccgaggccaccaccagcgcccugcaggcccacuucaaggugugcaagcugaccagcagauuccaggacaaccugagaaagagccugggcgccuacgagcccaagcagggcugcuacagaacccugagccuguucagauacagaagcagauucuucgugggcuucaucuggugccugcugcuggugcuggagcugaucgugugggccgccagcgccgagacccagaaccugaacagcggcuggaccgacaccgcccacggcagcggcaucauccccaugagaaccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacggcaccuucaaccugaagaccgccuuccacugcuacggcagcugcgagaaguacgccuaccccuggcagaccgccggcugcuucaucgagaaggacuacgaguacgagagcggcuggggcugcaacccccccgacugccccggcgugggcaccggcugcaccgccugcggcguguaccuggacaagcugaagagcgugggcaaggccuucaagaucgugagccugagauacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccaguucggcgaccccggcgacaucaugagcacccccgugggcaugaagugccccgagcugaacggcagcuucagaaagaagugcgccuucgccaccacccccgugugccaguucgacggcaacacccugagcggcuacaagagaaugaucgccaccaaggacagcuuccagagcuucaacgugaccgagccccacaucagcgccagcagccuggaguggaucgaccccgacagcagccugagagaccacaucaacgugaucgugggcagagaccugagcuuccaggaccugagcgagacccccugccagguggaccuggccaccaccagcaucgacggcgccuggggcagcggcgugggcuucaaccuggugugcagcgugagccugaccgagugcagcaccuuccugaccagcaucaaggccugcgacagcgccaugugcuacggcagcaccaccgccaaccugcugagaggccagaacaccgugcacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaucagcugcugguucaccaagagcggcgaguggauccugggcgugcugaacggcaacuggauggugguggccgugcugguggcccuguucauccugagcaucuuccuguucacccugugcugccccagaagacccagcuacgccaaggagcacaagcccuga

SEQ ID NO: 8517 - RNA, 3447 nt, Artificial Sequence
  derived and/or modified CDS sequence (opt4) from PUUV(PUUV/Konnevesi/Mg_M105A/2005)__JQ319173.1__GP
augggcaagagcagccccgugugccuguaccugauccugcagggccugcugcugaucggcgccgugaacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaccaagagcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugccugaccaccaagagcugccugcugggccugggcgaccagagaauccaggugaacuacgagagaaccuacugcgugagcggccagcugguggagggcgugugcuucaaccccauccacaccauggcccugagccagcccagccacaccuacgacaucgugaccgugauggugagaugcuuccuggugaucaagaaggugaccagcggcgacagcaugaagaucgagaagaacuucgagacccuggugcagaagaccggcugcaccgccaacagcuuccagggcuacuacaucugccuggugggcagcagcagcgagccccuguacgugcccacccuggacgacuacagaagcgccgaggugcugagcagaauggccuucgccccccacggcgaggaccacgacaucgagaagaacgccaucagcgcccugagaaucgccggcaaggugaccggcaaggcccccagcaccgagagcagcgacaccgugcagggcaucgccuucagcggcagcccccuguacaccagcaccggcgugcugaccgccaaggacgaccccguguacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagccugauccccggcaucgcccacagccuggccguggagcugugcgugcccggccugcacggcugggccaccgugcugcugcugcugaccuucugcuucggcugggugcugauccccaccaucaccaugauccugcugaagauccugaucgccuucgccuaccugugcagcaaguacaacaccgacagcaaguucaagauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccacccccagcgcccugcaggcccacuucaaggugugcaagcugaccagcagauuccaggagaaccugaagaagagccugaccauguacgagcccaugcagggcugcuacagaacccugagccuguucagauacagaagcagauucuucgugggccugguguggugcaugcugcuggugcuggagcugaucgugugggccgccagcgccgagacccagaaccugaacgccggcuggaccgacaccgcccacggcagcggcaucauccccaugaaggccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccugaccgccagcgccaucgacggcgccuggggcagcggcgugggcuucaaccuggugugcaccaucagccugaccgagugcagcaccuuccugaccagcaucaaggccugcgacgccgccaugugcuacggcagcaccaccaccaaccuggugagaggccagaacaccauccacguggugggcaagggcggccacagcggcagcaaguucaugugcugccacgacaccaagugcagcagcaccggccugguggccgccgccccccaccugaacagagugaccggcuucaaccaggccgacagcgacaagaucuucgacgacggcgcccccgagugcggcgugagcugcugguucaagaagagcggcgagugggugcugggcgugcugaacggcaacuggauggugguggccgugcugaucgcccugcugauccugagcaucuuccuguucgcccugugcugccccagaagacccagcuacaagaaggagcacaagcccuga

SEQ ID NO: 8518 - RNA, 3447 nt, Artificial Sequence
  derived and/or modified CDS sequence (opt4) from PUUV(PUUV/Konnevesi/Mg_M114B/2005)__JQ319175.1__GP
augggcaagagcagccccgugugccuguaccugauccugcagggccugcugcuguucggcgccgugaacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaucaagaacgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugccugaccaccaagagcugccugcugggccugggcgaccagagaauccaggugaacuacgagagaaccuacugcgugagcggccagcugguggagggcgugugcuucaaccccauccacaccauggcccugagccagcccagccacaccuacgacaucgugaccaucauggugagaugcuuccuggugaucaagaaggugaccagcggcgacaacaugaagaucgagaagaacuucgagacccuggugcagaagaccggcugcaccgccaacagcuuccagggcuacuacaucugccuggugggcagcagcagcgagccccuguacgugcccacccuggacgacuacagaagcgccgaggugcugagcagaauggccuucgccccccacggcgaggaccacgacaucgagaagaacgccaucagcgcccugagaaucgccggcaaggugaccggcaaggcccccagcaccgagagcagcgacaccgugcagggcaucgccuucagcggcagcccccuguacaccagcaccggcgugcugaccgccaaggacgaccccguguacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagccugauccccggcaucgcccacagccuggccguggagcugugcgugcccggccugcacggcugggccaccgugcugcugcugcugaccuucugcuucggcugggugcugauccccaccaucaccaugauccugcugaagauccugaucgccuucgccuaccugugcagcaaguacaacaccgacagcaaguucaagauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccacccccagcgcccugcaggcccacuucaaggugugcaagcugaccagcagauuccaggagaaccugaagaagagccugaccauguacgagcccaugcagggcugcuacagaacccugagccuguucagauacagaagcagauucuucgugggccugguguggugcaugcugcuggugcuggagcugaucgugugggccgccagcgccgagacccagaaccugaacgccggcuggaccgacaccgcccacggcagcggcaucauccccaugaaggccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccugaucgccagcgccaucgacggcgccuggggcagcggcgugggcuucaaccuggugugcaccgugagccugaccgagugcagcaccuuccugaccagcaucaaggccugcgacgccgccaugugcuacggcagcaccaccaucaaccugaucagaggccagaacaccauccacguggugggcaagggcggccacagcggcagcaaguucaugugcugccacgacaccaagugcagcagcaccggccugguggccgccgccccccaccuggacagagugaccggcuucaaccaggccgacagcgacaagaucuucgacgacggcgcccccgagugcggcgugagcugcugguucaagaagagcggcgagugggugcugggcgugcugaacggcaacuggauggugguggccgugcugaucgcccugcugauccugagcaucuuccuguucgcccugugcugccccagaagacccagcuacaagaaggagcacaagcccuga

SEQ ID NO: 8519 - RNA, 3447 nt, Artificial Sequence
  derived and/or modified CDS sequence (opt4) from PUUV(PUUV/Konnevesi/Mg_M78B/2005)__JQ319174.1__GP
augggcaagagcagccccgugugccuguaccugauccugcagggccugcugcuguucggcgccgugaacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaucaagaacgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugccugaccaccaagagcugccugcugggccugggcgaccagagaauccaggugaacuacgagagaaccuacugcgugagcggccagcugguggagggcgugugcuucaaccccauccacaccauggcccugagccagcccagccacaccuacgacaucgugaccaucauggugagaugcuuccuggugaucaagaaggugaccagcggcgacaacaugaagaucgagaagaacuucgagacccuggugcagaagaccggcugcaccgccaacggcuuccagggcuacuacaucugccuggugggcagcagcagcgagccccuguacgugcccacccuggacgacuacagaagcgccgaggugcugagcagaauggccuucgccccccacggcgaggaccacgacaucgagaagaacgccaucagcgcccugagaaucgccggcaaggugaccggcaaggcccccagcaccgagagcagcgacaccgugcagggcaucgccuucagcggcagcccccuguacaccagcaccggcgugcugaccgccaaggacgaccccguguacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccaagcagcagaucaaguucgugugccagagaguggacauggacaucaccguguacugcaacggcgugaagaaggugauccugaccaagacccuggugaucggccagugcaucuacaccuucaccagcaucuucagccugauccccggcaucgcccacagccuggccguggagcugugcgugcccggccugcacggcugggccaccgugcugcugcugcugaccuucugcuucggcugggugcugauccccaccaucaccaugauccugcugaagauccugaucgccuucgccuaccugugcagcaaguacaacaccgacagcaaguucaagauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccacccccagcgcccugcaggcccacuucaaggugugcaagcugaccagcagauuccaggagaaccugaagaagagccugaccauguacgagcccaugcagggcugcuacagaacccugagccuguucagauacagaagcagauucuucgugggccugguguggugcaugcugcuggugcuggagcugaucgugugggccgccagcgccgagacccagaaccugaacgccggcuggaccgacaccgcccacggcagcggcaucauccccaugaaggccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgacaugaccgccagcgccaucgacggcgccuggggcagcggcgugggcuucaaccuggugugcaccgugagccugaccgagugcagcaccuuccugaccagcaucaaggccugcgacgccgccaugugcuacggcagcaccaccaccaaccuggugagaggccagaacaccauccacguggugggcaagggcggccacagcggcagcaaguucaugugcugccacgacaccaagugcagcagcaagggccugguggccgccgccccccaccuggacagagugaccggcuucaaccaggccgacagcgacaagaucuucgacgacggcgcccccgagugcggcgugagcugcugguucaagaagagcggcgagugggugcugggcgugcugaacggcaacuggauggugguggccgugcugaucgcccugcugauccugagcaucuuccuguucgcccugugcugccccagaagacccagcuacaagaaggagcacaagcccuga

SEQ ID NO: 8520 - RNA, 3447 nt, Artificial Sequence
  derived and/or modified CDS sequence (opt4) from PUUV(PUUV/Konnevesi/Mg_O78A/2005)__JQ319172.1__GP
augggcaagagcagccccgugugccuguaccugauccugcagggccugcugcuguucggcgccgugaacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaucaagagcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugccugaccaccaagagcugccugcugggccugggcgaccagagaauccaggugaacuacgagagaaccuacugcgugagcggccagcugguggagggcgugugcuucaaccccauccacaccauggcccugagccagcccagccacaccuacgacaucgugaccaucauggugagaugcuuccuggugaucaagaaggugaccagcggcgacagcaugaagaucgagaagaacuucgagacccuggugcagaagaccggcugcaccgccaacagcuuccagggcuacuacaucugccuggugggcagcagcagcgagccccuguacgugcccacccuggacgacuacagaagcgccgaggugcugagcagaauggccuucgccccccacggcgaggaccacgacaucgagaagaacgccaucagcgcccugagaaucgccggcaaggugaccggcaaggcccccagcaccgagagcagcgacaccgugcagggcaucgccuucagcggcagcccccuguacaccagcaccggcgugcugaccgccaaggacgaccccguguacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagccugauccccggcaucgcccacagccuggccguggagcugugcgugcccggccugcacggcugggccaccgugcugcugcugcugaccuucugcuucggcugggugcugauccccaccaucaccaugauccugcugaagauccugaucgccuucgccuaccugugcagcaaguacaacaccgacagcaaguucaagauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccacccccagcgcccugcaggcccacuucaaggugugcaagcugaccagcagauuccaggagaaccugaagaagagccugaccauguacgagcccaugcagggcugcuacagaacccugagccuguucagauacagaagcagauucuucgugggccugguguggugcaugcugcuggugcuggagcugaucgugugggccgccagcgccgagacccagaaccugaacgccggcuggaccgacaccgcccacggcagcggcaucauccccaugaaggccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccugaccgccagcgccaucgacggcgccuggggcagcggcgugggcuucaaccuggugugcaccaucagccugaccgagugcagcaccuuccugaccagcaucaaggccugcgacgccgccaugugcuacggcagcaccaccaccaaccuggugagaggccagaacaccauccacguggugggcaagggcggccacagcggcagcaaguucaugugcugccacgacaccaagugcagcagcaccggccugguggccgccgccccccaccugaacagagugaccggcuucaaccaggccgacagcgacaagaucuucgacgacggcgcccccgagugcggcgugagcugcugguucaagaagagcggcgagugggugcugggcgugcugaacggcaacuggauggugguggccgugcugaucgcccugcugauccugagcaucuuccuguucgcccugugcugccccagaagacccagcuacaagaaggagcacaagcccuga

SEQ ID NO: 8521 - RNA, 3447 nt, Artificial Sequence
  derived and/or modified CDS sequence (opt4) from PUUV(PUUV/Pieksamaki/human_kidney/2008)__JN831951.1__GP
augggcaagagcagccccgugugccuguaccugauccugcagggccugcugcuguucggcgccgugaacgccagaaaccugaacgagcugaagauggagugcccccacaccaucggccugggccagggccugguggugggcagcguggagcugccccccgugcccauccagcagguggagagccugaagcuggagagcagcugcaacuucgaccugcacaccagcaccgccggccagcagagcuucaccaaguggaccugggagaucaagagcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugccugaccaccaagagcugccugcugggccugggcgaccagagaauccaggugaacuacgagagaaccuacugcgugagcggccagcugguggagggcgugugcuucaaccccauccacaccauggcccugagccagcccagccacaccuacgacguggugaccaucauggugagaugcuuccuggugaucaagaaggugaccagcggcgacagcaugaagaucgagaagaacuucgagacccuggugcagaagaccggcugcaccgccaacaacuuccagggcuacuacaucugccuggugggcagcagcagcgagccccuguacgugcccacccuggacgacuacagaagcgccgaggugcugagcagaauggccuucgccccccacggcgaggaccacgacaucgagaagaacgccaucagcgcccugagaaucgccggcaaggugaccggcaaggcccccagcaccgagagcagcgacaccgugcagggcaucgccuucagcggcagcccccuguacaccagcaccggcgugcugaccgccaaggacgaccccguguacaucugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagccugauccccggcaucgcccacagccuggccguggagcugugcgugcccggccugcacggcugggccaccgugcugcugcugcugaccuucugcuucggcugggugcugauccccaccaucaccaugauccugcugaagauccugaucgccuucgccuaccugugcagcaaguacaacaccgacagcaaguucaagauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccacccccagcgcccugcaggcccacuucaaggugugcaagcugaccagcagauuccaggagaaccugaagaagagccugaccauguacgagcccaugcagggcugcuacagaacccugagccuguucagauacagaagcagauucuucgugggccugguguggugcaugcugcuggugcuggagcugaucgugugggccgccagcgccgagacccagaaccugaacgccggcuggaccgacaccgcccacggcagcggcaucauccccaugaaggccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccugaccgccagcgccaucgacggcgccuggggcagcggcgugggcuucaaccuggugugcaccaucagccugaccgagugcagcaccuuccugaccagcaucaaggccugcgacgccgccaugugcuacggcagcaccaccaccaaccuggugagaggccagaacaccauccacguggugggcaagggcggccacagcggcagcaaguucaugugcugccacgacaccaagugcagcagcaccggccugguggccgccgccccccaccuggacagagugaccggcuucaaccaggccgacagcgacaagaucuucgacgacggcgcccccgagugcggcgugagcugcugguucagaaagagcggcgagugggugcugggcgugcugaacggcaacuggauggugguggccgugcugaucgcccugcugauccugagcaucuuccuguucgcccugugcugccccagaagacccagcuacaagaaggagcacaagcccuga

SEQ ID NO: 8522 - RNA, 3447 nt, Artificial Sequence
  derived and/or modified CDS sequence (opt4) from PUUV(Samara_49/CG/2005)__AB433850.2__GP
augggcaagcugagccccgugugccuguaccugcugcugcagggccugcugcugugcaagaccggcaccgccagaaaccugaacgagcugaagauggagugcccccacaccaucggccugggccagggccugguggugggcagcguggagcugccccccgugcccauccagcagguggagacccugaagcuggagagcagcugcaacuucgaccugcacaccagcaccgccggccagcaggccuucaccaaguggaccugggagaucaagggcgaccuggccgagaacacccaggccagcagcaccagcuuccagaccaagagcagcgaggugaaccugagaggccugugccugauccccacccuggugaucgagaccgccgccagaaugagaaagaccaucgccugcuacgaccugagcugcaaccagaccgugugccagcccaccguguaccugaugggccccauccagaccugcaucaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacaucgugaccaugauggugagaugcuuccuggugaucaagaaggugaccagcggcgacagcaugaagaucgagaagaacuucgagacccuggugcagaagaacggcugcaccgccaacagcuuccagggcuacuacaucugccugaucggcagcagcagcgagccccuguacgugcccacccuggacgacuacagaagcgccgaggugcugagcagaauggccuucgccccccacggcgaggaccacgacguggagaagaacgccaucagcgcccugagaaucgccggcaaggugaccggcaaggcccccagcaccgagagcagcgacaccgugcagggcaucgccuucagcggcagcccccuguacaccagcaccggcgugcugaccgccaaggacgaccccguguacaucugggcccccggcaucaucauggagggcaaccacagcgugugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacaagaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaacauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcgccuaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgaccugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugaucgugagcagagaccugagcuuccaggaccugagcgagacccccugccagaucgaccugagcaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccugaucagaggccagaacaccauccacaucgugggcaagggcggccacagcggcagcaaguucaugugcugccacgacaccaagugcagcaccaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugaucgcccugcuggugcugagcauccugcuguucacccugugcugccccagaagacccagcuacagaaaggagcacaagcccuga

SEQ ID NO: 8523 - RNA, 3447 nt, Artificial Sequence
  derived and/or modified CDS sequence (opt4) from PUUV(Samara_94/CG/2005)__AB433852.2__GP
augggcaagcugagccccgugugccuguaccugcugcugcagggccugcugcugugcaacaccggcaccgccagaaaccugaacgagcugaagaucgagugcccccacaccaucggccugggccagggccugguggugggcagcguggagcugccccccgugcccauccagcagguggagacccugaagcuggagagcagcugcaacuucgaccugcacaccagcaccgccggccagcaggccuucaccaaguggaccugggagaucaagggcgaccuggccgagaacacccaggccagcagcaccagcuuccagaccaagagcagcgaggugaaccugagaggccugugccugauccccacccuggugaucgagaccgccgccagaaugagaaagaccaucgccugcuacgaccugagcugcaaccagaccgugugccagcccaccguguaccugaugggccccauccagaccugcaucaccaccaagagcugccugcugggccugggcgaccagagaauccaggugaacuacgagaagaccuacugcgugagcggccagcugguggagggcgugugcuucaaccccauccacaccauggcccugagccagcccagccacaccuacgacaucgugaccaugauggugagaugcuuccugaucaucaagaaggugaccagcggcgacagcaugaagaucgagaagaacuucgagacccuggugcagaagaacgacugcaccgccaacagcuuccagggcuacuacaucugcuucaucggcagcagcagcgagccccuguacgugcccacccuggacgacuacagaagcgccgaggugcugagcagaauggccuucgccccccacggcgaggaccacgacguggagaagaacgccaucagcgcccugagaaucgccggcaaggugaccggcaaggcccccagcaccgagagcagcgacaccgugcagggcaucgccuucagcggcagcccccuguacaccagcaccggcgugcuggccgccaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccaccaucaccaugauccugcugaagauccugaucgccuucgccuaccugugcagcaaguacaacaccgacagcaaguucagaauccugaucgagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaacauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcgccuaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgaccugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugaucgugagcagagaccugagcuuccaggaccugagcgagacccccugccagaucgaccugagcaccaccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccugaucagaggccagaacaccauccacaucgugggcaagggcggccacagcggcagcaaguucaugugcugccacgacaccaagugcagcaccaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugaucgcccugcuggugcugagcauccugcuguucacccugugcugccccagaagacccagcuacagaaaggagcacaagcccuga

SEQ ID NO: 8524 - RNA, 3447 nt, Artificial Sequence
  derived and/or modified CDS sequence (opt4) from PUUV(Sotkamo)__NC_005223.1__GP
augggcaagagcagccccgugugccuguaccugauccugcagggccugcugcuguucgacaccgugaacgccaagaaccugaacgagcugaagauggagugcccccacaccaucggccugggccagggccugguggugggcagcguggagcugccccccgugcccauccagcagaucgagagccugaagcuggagagcagcugcaacuucgaccugcacaccagcaccgccggccagcagagcuucaccaaguggaccugggagaccaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugccugaccaccaagagcugccugcugggccugggcgaccagagaauccaggugaacuacgagagaaccuacugcgugagcggccagcugguggagggcgugugcuucaaccccauccacaccauggcccugagccagcccagccacaccuacgacaucgugaccaucauggugagaugcuuccuggugaucaagaaggugaccagcggcgacagcaugaagaucgagaagaacuucgagacccuggugcagaagaccggcugcaccgccaacggcuuccagggcuacuacaucugccugaucggcagcagcagcgagccccuguacgugcccacccuggacgacuacagaagcgccgaggugcugagcagaauggccuucgccccccacggcgaggaccacgacaucgagaagaacgccgugagcgcccugagaaucgccggcaaggugaccggcaaggcccccagcaccgagagcagcgacaccgugcagggcaucgccuucagcggcagcccccuguacaccagcaccggcgugcugaccgccaaggacgaccccguguacgugugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagcaugauccccggcaucgcccacagccuggccguggagcugugcgugcccggccugcacggcugggccaccgugcugcugcugcugaccuucugcuucggcugggugcugauccccaccaucaccaugauccugcugaagauccugaucgccuucgccuaccugugcagcaaguacaacaccgacagcaaguucagaauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccacccccagcgcccugcaggcccacuucaaggugugcaagcugaccagcagauuccaggagaaccugaagaagagccugaccauguacgagcccaugcagggcugcuacagaacccugagccuguucagauacagaagcagauucuucgugggccugguguggugcaugcugcuggugcuggagcugaucgugugggccgccagcgccgagacccagaaccugaacgacggcuggaccgacaccgcccacggcagcggcaucauccccaugaaggccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccggccagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugguggccaccaaggacagcuuccagagcuucaacgugaccgagccccacaucagcaccagcgcccuggaguggaucgaccuggacagcagccugagagaccacaucaacgugaucgugagcagagaccugagcuuccaggaccugagcgagacccccugccagguggaccugaccaccagcgccaccgacggcgccuggggcagcggcgugggcuucaaccuggugugcaccgugagccugaccgagugcagcgccuuccugaccagcaucaaggccugccacgccgccaugugcuacggcagcaccaccaccaaccuggugagaggccagaacaccauccacguggugggcaagggcggccacagcggcagcaaguucaugugcugccacgacaccaagugcagcagcaccggccugguggccgccgccccccaccuggacagagugaccggcuucaaccaggccgacagcgacaagaucuucgacgacggcgcccccgagugcggcaugagcugcugguucaagaagcugggcgagugggugcugggcgugcugaacggcaacuggauggugguggccgugcugaucgcccugcugauccugagcaucuuccuguucgcccugugcugccccagaagacccagcuacaagaaggaccacaagcccuga

SEQ ID NO: 8525 - RNA, 3447 nt, Artificial Sequence
  derived and/or modified CDS sequence (opt4) from PUUV(2009)__HE801634.1__GP
augggcaagagcagccccgugugccuguaccugauccugcagggccugcugcuguucgacaccgugaacgccagaaaccugaacgagcugaagauggagugcccccacaccaucggccugggccagggccugguggugggcagcguggagcugccccccgugcccauccagcagaucgagagccugaagcuggagagcagcugcaacuucgaccugcacaccagcaccgccggccagcagagcuucaccaaguggaccugggagaccaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugccugaccaccaagagcugccugcugggccugggcgaccagagaauccaggugaacuacgagagaaccuacugcgugagcggccagcugguggagggcgugugcuucaaccccauccacaccauggcccugagccagcccagccacaccuacgacaucgugaccaucauggugagaugcuuccuggugaucaagaaggugaccagcggcgacagcaugaagaucgagaagaacuucgagacccuggugcagaagaccggcugcaccgccaacggcuuccagggcuacuacaucugccugaucggcagcagcagcgagccccuguacgugcccacccuggacgacuacagaagcgccgaggugcugagcagaauggccuucgccccccacggcgaggaccacgacaucgagaagaacgccgugagcgcccugagaaucgccggcaaggugaccggcaaggcccccagcaccgagagcagcgacaccgugcagggcaucgccuucagcggcagcccccuguacaccagcaccggcgugcugaccgccaaggacgaccccguguacgugugggcccccggcaucaucauggagggcaaccacagcgugugcgagaagaagacccugccccugaccuggaccggcuucaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcgugaagaaggugauccugaccaagacccuggugaucggccagugcaucuacaccuucaccagcaucuucagccugauccccggcaucgcccacagccuggccguggagcugugcgugcccggccugcacggcugggccaccgugcugcugcugcugaccuucugcuucggcugggugcugauccccaccaucaccaugauccugcugaagauccugaucgccuucgccuaccugugcagcaaguacaacaccgacagcaaguucaagauccugguggagaaggugaagaaggaguaccagaagaccaugggcagcauggugugcgaggugugccaguacgagugcgagaccgccaaggagcuggagagccacagaaagagcugcagcaucggcagcugccccuacugccugaaccccagcgaggccacccccagcgcccugcaggcccacuucaaggugugcaagcugaccagcagauuccaggagaaccugaagaagagccugaccauguacgagcccaugcagggcugcuacagaacccugagccuguucagauacagaagcagauucuucgugggccugguguggugcaugcugcuggugcuggagcugaucgugugggccgccagcgccgagacccagaaccugaacgccggcuggaccgacaccgcccacggcagcggcaucauccccaugaaggccgaccuggagcuggacuucagccugcccagcagcgccagcuacaccuacagaagacagcugcagaaccccgccaacgagcaggagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucguggagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugguggccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagguggaccugaccaccagcgccaucgacggcgccuggggcagcggcgugggcuucaaccuggugugcaccgugagccugaccgagugcagcgccuuccugaccagcaucaaggccugcgacgccgccaugugcuacggcagcaccaccaccaaccuggugagaggccagaacaccauccacguggugggcaagggcggccacagcggcagcaaguucaugugcugccacgacaccaagugcagcagcaccggccugguggccgccgccccccaccuggacagagugaccggcuucaaccaggccgacagcgacaagaucuucgacgacggcgcccccgagugcggcaugagcugcugguucaagaagcugggcgagugggugcugggcgugcugaacggcaacuggauggugguggccgugcugaucgcccugcugauccugagcaucuuccuguucgcccugugcugccccagaagacccagcuacaagaaggagcacaagcccuga

SEQ ID NO: 8526 - RNA, 3447 nt, Artificial Sequence
  derived and/or modified CDS sequence (opt4) from PUUV(Umea/hu)__AY526218.1__GP
augggcaagcugagccccgugugccuguaccuguuccugcagugccugcugcuguggagcagaggcagcgccagaaaccugaacgagcugaagauggagugcccccacaccaucggccugggccagggccuggugaucggcagcguggagcugccccccgugcccgugcagcagguggagagccugaagcuggagagcagcugcaacuucgaccugcacaccagcaccgccacccagcagagcuucaccaaguggaccugggagaugaaggacgaccuggccgagaacacccaggccagcagcaccagcuuccagaccaagagcagcgaggugaaccugagaggccugugccugauccccccccuggugguggagaccgccagcagaaccagaaagaccaucgccugcuucgacaucagcugcaaccagaccgugugccagcccaccguguaccuggugggccccauccagaccugcaucaccaccaagagcugccugcugggccugggcgaccagagaauccaggugaacuacgagaagaccuacugcgugagcggccagcugguggagggcgugugcuucaaccccgugcacaccauggugcugagccagcccagccacaccuacgacaucgugaccaugauggugagaugcuuccugguggugaagaaggugaccagcggcgacagcaugaagaucgagaagaaccuggagacccuggugcagaagaccgacugcaacgccaacggcuuccagggcuacuacaucugccuggugggcagcagcagcgagccccuguacgugcccacccuggacgacuacagaagcgccgaggugcugagcagaauggccuucgccccccacggcgaggaccacgacaucgagagaaacgccgugagcgcccugagaaucgugggcaaggugaccggcaaggcccccagcaccgaggccagcgacaccauccagggcaucgccuucagcggcagcccccuguacaccagcaccggcgugcugaccgccaaggacaaccccguguacguguggagccccggcaucaucauggagggcaaccacagcgugugcgagaagaagacccugccccugaccuggaccggcuucaucccccugcccggcgagaucggcaagaccagccagugcaccguguucugcacccuggccggccccggcgccgacugcgaggccuacagcgagaccggcaucuucaacaucagcagccccaccugccugaucaacagagcccagagauucagaggcgccgagcagcagaucaaguucgugugccagagaguggacauggacaucaccguguacugcaacggcaugaagaaggugauccugaccaagacccuggugaucggccagugcaucuacaccuucaccagcaucuucagccugauccccggcaucgcccacagccuggccguggagcugugcgugcccggccugcacggcugggccaccgugcugcugcugcugaccuucugcuucggcuggauccugauccccuucaucgccaugaucagccugaagauccugaucgccuucgccuaccugugcagcaaguacaacaccgacagcaaguucaagauccugaucgagaaggugaagaaggaguaccagaagaccaugggcagcauggugugcgaggugugccaguacgagugcgagaccgccaaggagcuggagagccacagaaagagcugccccaucggcagcugccccuacugccugaaccccagcgaggccaccaccagcgcccugcaggcccacuucaaggugugcaagcugaccagcagagugcaggacaaccugagaaagagccuggccgccuacgagcccaagcagggcugcuacagaacccugagccuguucagauacagaagcagauucuucgugggcuucaucuggugcauccugcuggugcuggagcugaucaucugggccgccagcgccgagacccagaaccugaacagcggcuggaccgacaccgcccacggcagcggcaucauccccaugagaaccgaccuggagcuggacuucagccugcccagcagcgccagcuacaccuacagaagacagcugcagaaccccgccaacgagcacgagaagauccccuuccaccugcagaucagcaagcaggugauccacgccgagauccagcaccugggccacuggauggacgccaccuucaaccugaagaccgccuuccacugcuacggcagcugcgagaaguacgccuaccccuggcagaccgccggcugcuucuucgagaaggacuacgaguucgagagcagcuggggcugcaacccccccgacugccccggcgugggcaccggcugcaccgccugcggcguguaccuggacaagcugaagagcgugggcaagguguucaagaucaucagccugagauacaccagaaaggccugcauccagcugggcaccgagcagaccugcaagagcguggacagcaacgacugccuggugaccaccagcgugaaggugugccugaucggcaccgugagcaaguuccagcccagcgacacccugcuguuccugggcccccuggagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgacccccacaucagcaccagcgcccuggaguggaucgaccccgacagcagccugagagaccacaucaacgugguggugagcagagaccugagcuuccaggaccugagcgagacccccugccagguggaccugaccaccagcagcaucgacggcgccuggggcagcggcgugggcuucaaccuggugugcaccgugagccugaccgagugcagcaccuuccugaccagcaucaaggccugcgacagcgccaugugcuacggcagcaccaccaucaaccugaugagaggccagaacaccgugcacaucgugggcaagggcggccacagcggcagcaaguucaugugcugccacgacaccaagugcagcagcaccggccugguggccgccgccccccaccuggacagagugaccggcuucaaccaggccgacagcgacaagaucuucgacgacggcgcccccgagugcggcaugagcugcugguucaagaagagcggcgaguggauccugggcgugcugaacggcaacuggcuggugguggccgugcugguggcccuguucauccugagcaucuuccuguucacccugugcugccccagaagacccaucuacgccaaggagcacaagcccuga

SEQ ID NO: 8527 - RNA, 3447 nt, Artificial Sequence
  derived and/or modified CDS sequence (opt4) from PUUV(P360)__L08755.1__GP
augggcgagcugagccccgugugccugugccugcugcugcagggccugcugcugugcaacaccggcgccgccagaaaccugaacgagcugaagauggagugcccccacaccaucagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugaccuucugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccuga

SEQ ID NO: 8528 - RNA, 3447 nt, Artificial Sequence
  derived and/or modified CDS sequence (opt4) from MUV(11-1)__JX028272.1__GP
augggcaagaucagccccguguaccuguaccugcuguuccagggccugcugcuguggagagacggccuggccagaaaccugaacgagcugaagauggagugcccccacaccaucggccugggccagggccuggugaucggcagcguggagcugccccccgugccccugagacagguggagagccugaagcuggagagcagcugcaacuucgaccugcacaccagcaccgccacccagcagagcuucaccaaguggaucugggagagcaagaacgaccugaccgacagcacccaggccagcagcaccagcuaccagaccaagagcaccgaggugaaccugaagggccugugccuggugcccacccuggugaucgagaccgccgccagaaccagaaagaccaucgccugcuucgaccugagcugcaaccagaccgugugccagcccaccguguaccugaucggccccauccagaccugcaucaccaccaagagcugccugaucggccugggcgaccagagaauccaggugaacuacgagaagaccuacugcgugagcggccagcugguggagggcgugugcuucaaccccauccacaccauggcccugagccagcccagccacaccuacgacguggugaccaugauggugagaugcuuccugguggugaagaaggugaccagcggcgacagcaugaagaucgagaagaacuucgagacccuggugcagaagaccggcugcagcaacaacaacuuccagggcuacuacgugugccugaucggcagcagcagcgagccccuguacgugcccacccuggacgacuacagaagcgccgagauccugagcagaauggccuucgccccccacggcgaggaccacgacaucgagagaaacgccaucagcgccaugagaaucgugggcaaggugaccggcaaggcccccagcagcgagagcagcgacaccgugcagggcguggccuucagcggcaacccccuguacaccagcaccggcgugcugaccagcaaggacgaccccguguacgugugggcccccggcaucaucauggagggcaaccacagcgugugcgacaagaagacccugccccugaccuggaccggcuacaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcaucaagaaggugauccugaccaagacccuggugaucggccagugcaucuacaccuucaccagcaucuucagccugaugcccggcguggcccacagccuggccguggagcugugcgugcccggccugcacggcugggccaccaugcugcugcugcugaccuucugcuucggcuggauccugauccccaccaucacccugauccugcugaagauccugcuggccuucgccuacgugugcagcaaguacaacaccgacagcaaguucaagauccugaucgagaaggugaagcaggaguaccagaagaccaugggcagcauggugugcgaggugugccagcacgagugcgagaccgccaaggagcuggagagccacaagaagagcugccccaucggcagcugccccuacugccugaaccccgccgaggccaccaccagcgcccugcaggcccacuucaaggugugcaagcugaccagcagauuccaggagaaccugagaaagagccugaccguguacgagcccaagcagggcugcuacagaacccugagccuguucagauacagaagcagaugcuucgugggccugaucuggugcauccugcugacccuggagcugaucgugugggccgccagcgccgagacccugaaccugaaccccggcuggaccgacaccgcccacggcagcggcaucgugcccaugaagaccgaccuggagcuggacuucagccugcccagcagcgccagcuacaccuacagaagaagccugcagaaccccgccaacgagcaggagcaggugcccuuccaccugcagaucgagaagcaggugauccacgccgagauccagcaccugggccacuggauggacgccaccuucaaccugaagaccgccuuccacugcuacggcgccugcgagaaguacgccuaccccuggcagaccgccggcugcuucguggagaaggacuucgaguucgagaacggcuggggcugcaacccccccgacugccccggcgugggcaccggcugcaccgccugcggcgccuaccuggacaagcugaagagcgugggcaagguguucaagaucgugagccugagauacaccagaaaggccugcauccagcugggcaccgagcagaccugcaagaacguggacagcaacgacugccuggugaccaccagcgugaaggugugccugaucggcaccaucagcaaguuccagcccagcgacacccugcuguuccugggcccccuggagcagggcggcaucaucuucaagcaguggugcaccaccaccugccaguucggcgaccccggcgacaucaugagcacccccaucggcaugaagugccccgagcugaacggcagcuucagaaagaagugcagcuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugguggugggcagagaccugcccuuccaggaccugagcgagacccccugccagaucgaccugagcaccagcagcaucgacggcgccuggggcagcggcgugggcuucaaccuggugugcagcgugagccugaccgagugcuucaccuuccugaacagcaucaaggccugcgacaccgccaugugcuacggcagcaccaccgccaaccuggugagaggccagaacaccgugcacguggugggcaagggcggccacagcggcagcaaguucaugugcugccacgacaccaagugcagcaacaccggccugcuggccgccgccccccaccuggacagagugaccggcuacaaccaggccgacagcgacaagguguucgacgacggcgcccccgagugcggcaugaccugcugguucaagaagagcggcgaguggaucaugggcgugcugagcggcaacuggauggugguggccgugcugaucacccugcuggugcugagcaucuuccuguucgcccugugcugccccagaagagccgccuacaagaaggagcacaagcccuga

SEQ ID NO: 8529 - RNA, 3447 nt, Artificial Sequence
  derived and/or modified CDS sequence (opt4) from MUV(11-4)__JX046483.1__GP
augggcaagaucagccccguguaccugugccugcugcugcagggccugcugcuguggagagacggccuggccagaaaccugaacgagcugaagauggagugcccccacaccaucggccugggccagggccuggugaucggcagcguggagcugccccccgugccccugagacagguggagagccugaagcuggagagcagcugcaacuucgaccugcacaccagcaccgccacccagcagagcuucaccaaguggaucugggagagcaagaacgaccugaccgacagcacccaggccagcagcaccagcuaccagaccaagagcaccgaggugaaccugaagggccugugccuggugcccacccuggugaucgagaccgccgccagaaccagaaagaccaucgccugcuucgaccugagcugcaaccagaccgugugccagcccaccguguaccugaucggccccauccagaccugcaucaccaccaagagcugccugaucggccugggcgaccagagaauccaggugaacuacgagaagaccuacugcgugagcggccagcugguggagggcgugugcuucaaccccauccacaccauggcccugagccagcccagccacaccuacgacguggugaccaugauggugagaugcuuccugguggugaagaaggugaccagcggcgacagcaugaagaucgagaagaacuucgagacccuggugcagaagaccggcugcagcaacaacaacuuccagggcuacuacgugugccugaucggcagcagcagcgagccccuguacgugcccacccuggacgacuacagaagcgccgagauccugagcagaauggccuucgccccccacggcgaggaccacgacaucgagagaaacgccaucagcgccaugagaaucgugggcaaggugaccggcaaggcccccagcagcgagagcagcgacaccgugcagggcaucgccuucagcggcaacccccuguacaccagcaccggcgugcugaccagcaaggacgaccccguguacgugugggcccccggcaucaucauggagggcaaccacagcgugugcgacaagaagacccugccccugaccuggaccggcuacaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcaucaagaaggugauccugaccaagacccuggugaucggccagugcaucuacaccuucaccagcaucuucagccugaugcccggcguggcccacagccuggccguggagcugugcgugcccggccugcacggcugggccaccaugcugcugcugcugaccuucugcuucggcuggauccugauccccaccaucacccugauccugcugaagauccugcuggccuucgccuacgugugcagcaaguacaacaccgacagcaaguucaagauccugaucgagaaggugaagcaggaguaccagaagaccaugggcagcauggugugcgaggugugccagcacgagugcgagaccgccaaggagcuggagagccacaagaagagcugccccaucggcagcugccccuacugccugaaccccgccgaggccaccaccagcgcccugcaggcccacuucaaggugugcaagcugaccagcagauuccaggagaaccugagaaagagccugaccguguacgagcccaagcagggcugcuacagaacccugagccuguucagauacagaagcagaugcuucgugggccugaucuggugcauccugcugacccuggagcugaucgugugggccgccagcgccgagacccugaaccugaaccccggcuggaccgacaccgcccacggcagcggcaucgugcccaugagaaccgaccuggagcuggacuucagccugcccagcagcgccagcuacaccuacagaagaagccugcagaaccccgccaacgagcaggagcagauccccuuccaccugcagaucgagaagcaggugauccacgccgagauccagcaccugggccacuggauggacgccaccuucaaccugaagaccgccuuccacugcuacggcgccugcgagaaguacgccuaccccuggcagaccgccggcugcuucguggagaaggacuucgaguucgagaacggcuggggcugcaacccccccgacugccccggcgugggcaccggcugcaccgccugcggcgccuaccuggacaagcugaagagcgugggcaagguguucaagaucgugagccugagauacaccagaaaggccugcauccagcugggcaccgagcagaccugcaagaacguggacagcaacgacugccuggugaccaccagcgugaaggugugccugaucggcaccaucagcaaguuccagcccagcgacacccugcuguuccugggcccccuggagcagggcggcaucaucuucaagcaguggugcaccaccaccugccaguucggcgaccccggcgacaucaugagcacccccaucggcaugaagugccccgagcugaacggcagcuucagaaagaagugcagcuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugguggugggcagagaccugcccuuccaggaccugagcgagacccccugccagaucgaccugagcaccagcagcaucgacggcgccuggggcagcggcgugggcuucaaccuggugugcagcgugagccugaccgagugcagcaccuuccugaccagcaucaaggccugcgacaccgccaugugcuacggcagcaccaccgccaaccuggugagaggccagaacaccgugcacguggugggcaagggcggccacagcggcagcaaguucgugugcugccacgacaccaagugcagcaacaccggccugcuggccgccgccccccaccuggacagagugaccggcuacaaccaggccgacagcgacaagguguucgacgacggcgcccccgagugcggcaugaccugcugguucaagaagagcggcgaguggaucaugggcgugcugagcggcaacuggauggugguggccgugcugaucacccugcuggugcugagcaucuuccuguucgcccugugcugccccagaagagccgccuacaagaaggagcacaagcccuga

SEQ ID NO: 8530 - RNA, 3447 nt, Artificial Sequence
  derived and/or modified CDS sequence (opt4) from MUV(11-5)__JX046486.1__GP
augggcaagaucagccccguguaccugugccugcugcugcagggccugcugcuguggagagacggccuggccagaaaccugaacgagcugaagauggagugcccccacaccaucggccugggccagggccuggugaucggcagcguggagcugccccccgugccccugagacagguggagagccugaagcuggagagcagcugcaacuucgaccugcacaccagcaccgccacccagcagagcuucaccaaguggaucugggagagcaagaacgaccugaccgacagcacccaggccagcagcaccagcuaccagaccaagagcaccgaggugaaccugaagggccugugccuggugcccacccuggugaucgagaccgccgccagaaccagaaagaccaucgccugcuucgaccugagcugcaaccagaccgugugccagcccaccguguaccugaucggccccauccagaccugcaucaccaccaagagcugccugaucggccugggcgaccagagaauccaggugaacuacgagaagaccuacugcgugagcggccagcugguggagggcgugugcuucaaccccauccacaccauggcccugagccagcccagccacaccuacgacguggugaccaugauggugagaugcuuccugguggugaagaaggugaccagcggcgacagcaugaagaucgagaagaacuucgagacccuggugcagaagaccggcugcagcaacaacaacuuccagggcuacuacgugugccugaucggcagcagcagcgagccccuguacgugcccacccuggacgacuacagaagcgccgagauccugagcagaauggccuucgccccccacggcgaggaccacgacaucgagagaaacgccaucagcgccaugagaaucgugggcaaggugaccggcaaggcccccagcagcgagagcagcgacaccgugcagggcaucgccuucagcggcaacccccuguacaccagcaccggcgugcugaccagcaaggacgaccccguguacgugugggcccccggcaucaucauggagggcaaccacagcgugugcgacaagaagacccugccccugaccuggaccggcuacaucccccugcccggcgagaucgagaagaccacccagugcaccguguucugcacccuggccggccccggcgccgacugcgaggccuacagcgagaccggcaucuucaacaucagcagccccaccugccugaucaacagagugcagagauucagaggcgccgagcagcagaucaaguucgugugccagagaguggacauggacaucaccguguacugcaacggcaucaagaaggugauccugaccaagacccuggugaucggccagugcaucuacaccuucaccagcaucuucagccugaugcccggcguggcccacagccuggccguggagcugugcgugcccggccugcacggcugggccaccaugcugcugcugcugaccuucugcuucggcuggauccugauccccaccaucacccugauccugcugaagauccugcuggccuucgccuacgugugcagcaaguacaacaccgacagcaaguucaagauccugaucgagaaggugaagcaggaguaccagaagaccaugggcagcauggugugcgaggugugccagcacgagugcgagaccgccaaggagcuggagagccacaagaagagcugccccaucggcagcugccccuacugccugaaccccgccgaggccaccaccagcgcccugcaggcccacuucaaggugugcaagcugaccagcagauuccaggagaaccugagaaagagccugaccguguacgagcccaagcagggcugcuacagaacccugagccuguucagauacagaagcagaugcuucgugggccugaucuggugcauccugcugacccuggagcugguggugugggccgccagcgccgagacccugaaccugaaccccggcuggaccgacaccgcccacggcagcggcaucgugcccaugagaaccgaccuggagcuggacuucagccugcccagcagcgccagcuacaccuacagaagaagccugcagaaccccgccaacgagcaggagcagauccccuuccaccugcagaucgagaagcaggugauccacgccgagauccagcaccugggccacuggauggacgccaccuucaaccugaagaccgccuuccacugcuacggcgccugcgagaaguacgccuaccccuggcagaccgccggcugcuucguggagaaggacuucgaguucgagaacggcuggggcugcaacccccccgacugccccggcgugggcaccggcugcaccgccugcggcgccuaccuggacaagcugaagagcgugggcaagguguucaagaucgugagccugagauacaccagaaaggccugcauccagcugggcaccgagcagaccugcaagaacguggacagcaacgacugccuggugaccaccagcgugaaggugugccugaucggcaccaucagcaaguuccagcccagcgacacccugcuguuccugggcccccuggagcagggcggcaucaucuucaagcaguggugcaccaccaccugccaguucggcgaccccggcgacaucaugagcacccccaucggcaugaagugccccgagcugaacggcagcuucagaaagaagugcagcuucgccaccacccccgugugccaguucgacggcaacaccaucagcggcuacaagagaaugaucgccaccaaggacagcuuccagagcuucaacgugaccgagccccacaucagcgccagcgcccuggaguggaucgaccccgacagcagccugagagaccacaucaacgugguggugggcagagaccugcccuuccaggaccugagcgagacccccugccagaucgaccugagcaccagcagcaucgacggcgccuggggcagcggcgugggcuucaaccuggugugcagcgugagccugaccgagugcagcaccuuccugaccagcaucaaggccugcgacaccgccaugugcuacggcagcaccaccgccaaccuggugagaggccagaacaccgugcacguggugggcaagggcggccacagcggcagcaaguucgugugcugccacgacaccaagugcagcaacaccggccugcuggccgccgccccccaccuggacagagugaccggcuacaaccaggccgacagcgacaagguguucgacgacggcgcccccgagugcggcaugaccugcugguucaagaagagcggcgaguggaucaugggcgugcugagcggcaacuggauggugguggccgugcugaucacccugcuggugcugagcaucuuccuguucgcccugugcugccccagaagagccgccuacaagaaggagcacaagcccuga

SEQ ID NO: 8531 - RNA, 3408 nt, Artificial Sequence
  derived and/or modified CDS sequence (opt4) from SANGV(SA14)__NC_034516.1__GP
augaucauguggggccugcugcugcuggccgccaucaccuuccccugccagagccugaagaacguguacgacaugaagaucgagugcccccacagcgugaacuucggcgagagcagcgugaugggcaaggugcagcugcccagccugagcaucaccgaggccgagcagcuggugcccgagagcagcugcaacauggacaaccaccagagccugagcgugcugcagaaggccaccaagaccaccuggagaaagaaggccgaccacagcaacgccggcaaggacagcuacgagcugaucaccagcgagauccaguucaagggcgugugcagccugacccacaagaugaucgaggagagccacagacugagaagaagcgugaucugcuacgaccugagcugcaacaccacccacugcaagcccacccuguacaugguggugcccgugcacagcugcaacaugaugaagagcugccugaucggccugggccccuacagaauccaggugguguacgagagaaccuacugcaccgugggcgugcugaacgagggcaagugcuucgugcccgaccagagcguggccaacaucgugaagaacggcaucuucgacaucgugagcgugcagaucaucugcuucuucaucagaaucaagggcagcaccuacaagauccuggagaccgugaagaccgccaugaacggcaagugcaacggcaccgacgacaaggugcagggcuacuacaucugccugcugggcggcaacagcggccccaucuacgugcccagcggcaccgacuucagagccauggaggcccuggccaacaugcugagagccccccacggcgaggaccacgaccugcccggcgaggagcuggccagcuacagcaucgccggcaccaucgagggcaagaucccccacaccgccagcagccagaaccuggaguucaccgccuacagcggcauccccagcuacagcagcuucagcgugcacacccugacccaggacggccagcugagcuacagccccggccuguuccccaaccugaaccagagcgacugcaagaagaacgcccugccccugaucugggagggcaccaucgagcugcccggcuacuacgaggccauccaccccugcaacguguucugcguguucagcggccccggcgccagcugcgaggccuucagcgagggcggcaucuucaacaucaccagccccaccugccuggugagcaagcagaacagauucagagccgccgagcagcagaucaccuucgugugccagagaguggacauggacaucaucaucuacugcaacggccagagaaaggugauccugaccaagacccuggugaucggccagugcaucuacagcaucaccagccuguucagccugcugcccagcguggcccacagcaucgccaucgagcugugcgugcccggcuuccacggcugggccaccgccgcccugcugaccaccuucugcuucggcuggcugcugauccccagcaucaccuacaucgugcugcugauccugaaguucaucgccgccaucuuccacaacaccacccaggagaacaaguucaaggccauccugagaaagaucaaggaggaguucgagaagaccaagggcagcauggugugcgacaucugcaaguacgagugcgagaccggcaaggagcugaaggcccacaaccugagcugcaaccagagccagugccccuacugcuucacccacugcgagaugaccgagagcgccuuccaggcccacuacaaggugugccaggccacccacagauucagagaggaccugaagaagaccaucaccccccagaccaucagccccggcugcuacagaacccugaaccuguucagauacaagagcagaugcuacauccugaccguguggcugugccugcugauccuggagagcaucgccugggccgccagcgccagcgagaccagccugaacccccuguggaccgacaacgcccacggcgugggcagcgugcccaugcacaccgaccuggagcuggacuucagccugcccagcagcagcaaguacaccuacaagagaaagcugaccagccccaccaaccccgagcaggccgugagccugcacaucgagaucgagagccagggcaucgccgccgacgugcacagccugggccacugguacgacgccagacugaaccugaagaccagcuuccacugcuacggcgccugcaccaaguaccaguaccccuggcacaccgccaagugccacuucgagcacgacuuccaguacgagaacagcuggggcugcaacccccccgacugccccggcgugggcaccggcugcaccgccugcggccuguaccuggaccagcugaagcccgugggcagcgccuacaagcugaucaccgugagauacagcagaaaggugugcgugcaguucggcgaggagaaccugugcaagaccaucgacaugaacgacugcuucaugagcagacacgugaaggugugcaucaucggcaccgugagcaaguucagccagggcgacacccugguguuccugggcccccuggagggcggcggccugaucuucaaggacuggugcaccagcaccugccaguacggcgaccccggcgacaucaugagccccagagacagaggcuucagcugccccgaguuccccggcagcuucagaaagaagugcaacuucgccaccacccccgugugcgaguacagcggcaacauggugagcggcuacaagaaggugauggccaccaucgacagcuuccagagcuucaacaccagccugauccacuucaccgaggagagaaucgaguggaaggaccccgacggcaugcugagagaccaccugaacauccuggugaccaaggacaucgacuucgagaaccugggcgagaaccccugcaaggugggccugcagaccagcagcaucgagggcgccuggggcagcggcgugggcuucacccuggugugccaggugagccugaucgacugcgccagauuccugaccagcaucaaggccugcgacauggccaucugcuacggcgcccagagcgugagccuggugagaggccagaacaccgugaagaucaccggcaagggcggccacagcggcagcagcuucaagugcugccacgagguggacugcagcagcaccggccugcaggccagcgccccccaccuggacaaggugaacggcaucagcgagcaggagaacgacaagguguacgacgacggcgccccccagugcggcgugagcugcugguucgugaagagcggcgaguggaucagcggcauccugcacggcaacugggugguggugguggugcuggugauccugcugcuguucagccugauccugcugagcauccugugccccgugagaaagcacaagagaagcuga

SEQ ID NO: 8532 - RNA, 3408 nt, Artificial Sequence; identical to SEQ ID NO: 8531
  derived and/or modified CDS sequence (opt4) from SANGV(SA14)__NC_034516.1__GP

SEQ ID NO: 8533 - RNA, 3402 nt, Artificial Sequence
  derived and/or modified CDS sequence (opt4) from SEOV(L99)__AF288298.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugguguggagaaagaaggccaaccaggagcuggccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccacaagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagagccugaagcugaucgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugacccccaagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacgccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucagcugccccgaguuccccggccaguucagaaagaagugcaacuucgccaccacccccaucugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagagccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugagaaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8534 - RNA, 3402 nt, Artificial Sequence
  derived and/or modified CDS sequence (opt4) from SEOV(Rn10-134)__JF693883.2__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccguggagaucccccuggugccccuguggaccgacaacgcccacggcgugggcagcgugcccaugcacaccgaccuggagcuggacuucagccugcccagcagcagcagauacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagccugaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8535 - RNA, 3402 nt, Artificial Sequence
  derived and/or modified CDS sequence (opt4) from SEOV(Gou3-e5)__AF288650.1__GP
auguggggccugcugcugcuggccgcccuggugggccagggccuggcccugaagaacguguucgacaugaagauccagugcccccacagcgugaacuucggcgagaccagcgugagcggcuacaccgagcugcccccccugccccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagaacgaggugagcuucaagggccugugcaugcugaagcacagaaugguggaggagagcuacagaaacagaagaagcgugaucugcuacgaccuggccugcaacaccaccuucugcaagcccaccguguacaugaucgugcccauccacgccugcaacaugaugaagagcugccugaucggccugggccccuacagaauccaggugaucuacgagagaaccuacugcaccaccggcauccugaccgagggcaagugcuucgugcccgacaaggccguggugagcgcccugaagagaggcauguacgccaucgccagcaucgagaccaucugcuucuucgugcaccagaagggcaacaccuacaagaucgugagcgccaucaccagcgccaugggcagcaagugcaacaacaccgacagcaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccauccaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucgugguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcuggugaccuucugcuucggcugggugcugauccccgccugcacccuggccgugcugcuguuccugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggauccugcugcuggugaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccggcugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacgugaucagcggcuacagaaaggugcuggccaccaucgacagcuuccagagcuucaacaccagcaacgugcacuucaccgacgagagaaucgaguggaaggaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccaucaagaucaccggcagaggcggccacagcggcagcagcuucaagugcugccacggcaaggagugcagcgccaacggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8536 - RNA, 3402 nt, Artificial Sequence
  derived and/or modified CDS sequence (opt4) from SEOV(China)__EU163437.1__GP
auguggagccugcugcugcuggccgcccuggugggccagggcuucgcccugaagaacguguucgacaugagaauccagugcccccacagcgugaaguucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgagauccuggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaucaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaaguacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagccagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcagaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugcuacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacagaagcuacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggccugggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8537 - RNA, 3402 nt, Artificial Sequence
  derived and/or modified CDS sequence (opt4) from SEOV(DPRK08)__JX853576.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugcccaucuggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcaugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8538 - RNA, 3402 nt, Artificial Sequence
  derived and/or modified CDS sequence (opt4) from SEOV(Fj372/2013)__KP645197.1__GP
auguggagccugcugcugcuggccgcccuggugggccccggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggcagaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8539 - RNA, 3402 nt, Artificial Sequence
  derived and/or modified CDS sequence (opt4) from SEOV(HeB38)__JN377554.1__GP
auguggagccugcugcugcuggccgcccuggugggccagggcuucgcccugaagaacguguucgacaugagaauccagugcccccacagcgugaaguucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggcagaagaaggccaaccaggagagcgccaaccagaacagcuucgagguggccgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccagcggcgaggacuucagagccauggagguguucagcggcaucaucaugagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugcugagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8540 - RNA, 3402 nt, Artificial Sequence
  derived and/or modified CDS sequence (opt4) from SEOV(JiangxiXinjianRn-07-2011)__KP859513.1__GP
auguggagccugcugcugcuggccgcccuggugggccagugcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguacuucugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8541 - RNA, 3402 nt, Artificial Sequence
  derived and/or modified CDS sequence (opt4) from SEOV(LYON/Rn/FRA/2013/LYO852)__KF387724.1__GP
auguggagccugcugcugcuggccgcccuggccggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagagcgaggugagcuucaagggccugugcaugcugagacacagaaugguggaggagagcuacaagaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucaucaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagccugaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcguguuccugcuguucagccugauccugcugagcauccugugccccgugagaaagcacaagaagagcuga

SEQ ID NO: 8542 - RNA, 3402 nt, Artificial Sequence
  derived and/or modified CDS sequence (opt4) from SEOV(Seoul-Baxter/NYC-D1_M)__KJ950863.1__GP
auguggagccugcugcugcuggccgcccuggugggccagggcuucgcccugaagaacguguucgacaugaagauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgagguggccgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacgacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugguguggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugccugcaguucggcgaggaguaccugugcaagaccaucgacaugaacgacugcuucgugaccagacacgugaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8543 - RNA, 3402 nt, Artificial Sequence
  derived and/or modified CDS sequence (opt4) from SEOV(Singapore/06(RN41))__GQ274942.1__GP
auguggagccugcugcugcuggccgcccuggccggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagagcgagaucagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8544 - RNA, 3402 nt, Artificial Sequence
  derived and/or modified CDS sequence (opt4) from SEOV(11CSG)__AB618131.1__GP
auguggagccugcugcugcuggccgcccuggccggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucgugcaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaaguucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaccaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggaucgugcugaucgugcugugcgugcugcugcuguucagccugauccugcugagcauccugugccccgugagaaagcacaagaagagcuga

SEQ ID NO: 8545 - RNA, 3402 nt, Artificial Sequence
  derived and/or modified CDS sequence (opt4) from SEOV(5CSG)__AB618130.1__GP
auguggagccugcugcugcuggccgcccuggccggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccauccaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagcgugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaccaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8546 - RNA, 3402 nt, Artificial Sequence
  derived and/or modified CDS sequence (opt4) from SEOV(80-39)__S47716.1__GP
auguggagccugcugcugcuggccgcccuggugggccagggcuucgcccugaagaacguguucgacaugagaauccagugcccccacagcgugaaguucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgagcugauggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagagugcaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccugaccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcagauacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucagagccugcgacauggccaucugcuacggcgccgagagcgugacccugagcagaggccagaacaccgugaagaucaccggcaagggcggccacagcggcagcagcuucaagugcugccacggcaaggagugcagccugaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8547 - RNA, 3402 nt, Artificial Sequence
  derived and/or modified CDS sequence (opt4) from SEOV(93HBQ3)__KM115585.1__GP
auguggagccugcugcugcuggccgcccuggugggccagggcuucgcccugaagaacguguucgacaugagaauccagugcccccacagcgugaaguucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggcagaagaaggccaaccaggagagcgccaaccagaacagcuucgagguggccgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccagcggcgaggacuucagagccauggagguguucagcggcaucaucaugagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgcccugaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugcugagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8548 - RNA, 3402 nt, Artificial Sequence
  derived and/or modified CDS sequence (opt4) from SEOV(93HBQ4)__KM115586.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgagguggccgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccagcggcgaggacuucagagccauggagguguucagcggcaucaucaugagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcggcgacagcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagaccaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagagaguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8549 - RNA, 3402 nt, Artificial Sequence
  derived and/or modified CDS sequence (opt4) from SEOV(B1)__AB457790.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugagacugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcuggauccugauccccgccuggacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaagaucugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugaagcugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugccugcugcugcuguucagccugauccugcugagcauccugugccccgugagaaagcacaagaagagcuga

SEQ ID NO: 8550 - RNA, 3402 nt, Artificial Sequence
  derived and/or modified CDS sequence (opt4) from SEOV(B1)__AB457791.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggcagaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccagguggccuacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugagacugaccgccuucgccggcauccccagcuacagcagcaccagcauccuggccgccagcaaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcuggauccugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaagaucugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugccugcugcugcuguucagccugauccugcugagcauccugugccccaucagaaagcacaagaagagcuga

SEQ ID NO: 8551 - RNA, 3402 nt, Artificial Sequence
  derived and/or modified CDS sequence (opt4) from SEOV(B1)__AB457792.1__GP
auguggagccugcugcugauggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggcagaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccagguggccuacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugagacugaccgccuucgccggcauccccagcuacagcagcaccagcauccuggccgccagcaaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcuggauccugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaagaucugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugccugcugcugcuguucagccugauccugcugagcauccugugccccaucagaaagcacaagaagagcuga

SEQ ID NO: 8552 - RNA, 3402 nt, Artificial Sequence
  derived and/or modified CDS sequence (opt4) from SEOV(B1)__AB457793.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggcagaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccagguggccuacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugagacugaccgccuucgccggcauccccagcuacagcagcaccagcauccuggccgccagcaaggacggccacuucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcuggauccugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaagaucugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugccugcugcugcuguucagccugauccugcugagcauccugugccccaucagaaagcacaagaagagcuga

SEQ ID NO: 8553 - RNA, 3402 nt, Artificial Sequence
  derived and/or modified CDS sequence (opt4) from SEOV(B1)__AB457794.1__GP
auguggagccugcugcugauggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggcagaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccagguggccuacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugagacugaccgccuucgccggcauccccagcuacagcagcaccagcauccuggccgccagcaaggacggccacuucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcuggauccugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaagaucugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugccugcugcugcuguucagccugauccugcugagcauccugugccccaucagaaagcacaagaagagcuga

SEQ ID NO: 8554 - RNA, 3402 nt, Artificial Sequence
  derived and/or modified CDS sequence (opt4) from SEOV(B-1)__X53861.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucuacuacgaccuggccggcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaaguggaacaaguacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccacaucagcggccagaucgaggccaagaucccccacaccgugagcagcaagaaccugagacuggccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagagaaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggagcaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccagagacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8555 - RNA, 3402 nt, Artificial Sequence
  derived and/or modified CDS sequence (opt4) from SEOV(BjHD01)__DQ133505.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagguggccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcgaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8556 - RNA, 3402 nt, Artificial Sequence
  derived and/or modified CDS sequence (opt4) from SEOV(Cherwell)__KM948593.1__GP
auguggagccugcugcugcuggccgcccuggugggccagggcagcgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccccaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggcguguaccuggaccagcugaagcccgugggcaccgccuucaagaucgugagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcagcgagugggugaugggcaucaucaacggcaacuggguggugcugaucgugcugugcgugcugcugcuguucagccugauccugcugagcauccugugccccgugagaaagcacaagaagagcuga

SEQ ID NO: 8557 - RNA, 3402 nt, Artificial Sequence
  derived and/or modified CDS sequence (opt4) from SEOV(HaixingRn40)__GU592924.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccagaacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccugggccagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgaccuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8558 - RNA, 3402 nt, Artificial Sequence
  derived and/or modified CDS sequence (opt4) from SEOV(HBQ17)__KM233655.1__GP
auguggagccugcuguucguggccgcccugaucggccagggcuucgcccuggagaacgccuucgacaugagaaucagaugcccccacagcgugcacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgcccugaagaucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8559 - RNA, 3402 nt, Artificial Sequence
  derived and/or modified CDS sequence (opt4) from SEOV(HBQ20)__KM233656.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgugaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaccgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8560 - RNA, 3402 nt, Artificial Sequence
  derived and/or modified CDS sequence (opt4) from SEOV(HBQ43)__KM233657.1__GP
auguggagccugcuguuccuggccgcccuggugggccagggcguggcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcuucagcgagcuggagaacgagaagguguacgacgacggcgcccccgagugcggcgugaccugcugguucaagaagagcggcgagugggugaugggcaucaucaacggcaacuggguggugcugaucgugcugugcauccugcugcuguucagccugauccugcugagcauccugugccccgugagaaagcacaagaagagcuga

SEQ ID NO: 8561 - RNA, 3402 nt, Artificial Sequence
  derived and/or modified CDS sequence (opt4) from SEOV(HBQ5)__KM233653.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8562 - RNA, 3402 nt, Artificial Sequence
  derived and/or modified CDS sequence (opt4) from SEOV(HBT14)__KM233658.1__GP
auguggagccugcuguuccuggccgcccuggugggccagggcuucgcccugaagaacguguucgacaugagaauccagugcccccacagcgugaacuucggcgagaccagcgugagcggcuacaccggccugcccccccugagccugcaggaggccgagcagcuggugcccgagagcagcugcaacauggacaaccaccagagccugagcaucaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8563 - RNA, 3402 nt, Artificial Sequence
  derived and/or modified CDS sequence (opt4) from SEOV(HBT-3)__KM233661.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccugcccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagaccuucaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8564 - RNA, 3402 nt, Artificial Sequence
  derived and/or modified CDS sequence (opt4) from SEOV(HBT49)__KM233659.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacguguaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8565 - RNA, 3402 nt, Artificial Sequence
  derived and/or modified CDS sequence (opt4) from SEOV(HBT50)__KM233660.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucagacacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8566 - RNA, 3402 nt, Artificial Sequence
  derived and/or modified CDS sequence (opt4) from SEOV(HuludaoRn101)__GU592923.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugguguggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaucgccuucgccggcauccccagcuacagcagcaccagcauccuggccgccagcgaggacagcagauucaucuucagccccggccuguuccccaaccugaaccagagcgugugcgacaacaacgcccugccccugaucuggagaggccugaucgaccugaccggcuacuacgagaccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcauccccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccaucugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacguggugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugagaaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8567 - RNA, 3402 nt, Artificial Sequence
  derived and/or modified CDS sequence (opt4) from SEOV(Humber)__JX879768.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucgugcaccagaagggcaacaccuacaagaucgugaccgccaucaccagcgccaugggcagcaagugcaacaacaccgacaccaaggugcagggcuacuacaucugcaucaucggcggcaacagcgcccccguguacagccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccgugcugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcauccagggcgagugccccuacugcuucacccacugcgagcccaccgagaccgccauccaggcccacuacaaggugugccaggccacccacagauucagagaggaccugaagaagaccgugaccccccccaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucaucaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaacggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8568 - RNA, 3402 nt, Artificial Sequence
  derived and/or modified CDS sequence (opt4) from SEOV(Humber)__KM948597.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucgugcaccagaagggcaacaccuacaagaucgugaccgccaucaccagcgccaugggcagcaagugcaacaacaccgacaccaaggugcagggcuacuacaucugcaucaucggcggcaacagcgcccccguguacagccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccgugcugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcauccagggcgagugccccuacugcuucacccacugcgagcccaccgagaccgccauccaggcccacuacaaggugugccaggccacccacagauucagagaggaccugaagaagaccgugaccccccccaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucaucaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugcugagaggccagaacaccgugaagaucaccggcaagggcggccacagcggcagcagcuucaagugcugccacggcaaggagugcagcagcaacggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8569 - RNA, 3402 nt, Artificial Sequence
  derived and/or modified CDS sequence (opt4) from SEOV(K24-e7)__AF288652.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugguguggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccggcaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaucgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucagagugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcaugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccaucugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugagaaucaccggcagaggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8570 - RNA, 3402 nt, Artificial Sequence
  derived and/or modified CDS sequence (opt4) from SEOV(K24-v2)__AF288654.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugguguggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaccgccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgacgaccacgaccugcccggcgaggagaucgcccccuaccagaucagcggccagaucgaggccaagaucccccacaccgugagcagcaagaaccugaagcugaucgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacgaccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacggcgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcaugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccaucugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugagaaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8571 - RNA, 3402 nt, Artificial Sequence
  derived and/or modified CDS sequence (opt4) from SEOV(KI-83-262)__D17592.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugagccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8572 - RNA, 3402 nt, Artificial Sequence
  derived and/or modified CDS sequence (opt4) from SEOV(KI-85-1)__D17593.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcgccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagcuucauccugcugagcauccugugccccgugagaaagcacaagaagagcuga

SEQ ID NO: 8573 - RNA, 3402 nt, Artificial Sequence
  derived and/or modified CDS sequence (opt4) from SEOV(KI-88-15)__D17594.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgagaucguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcugaagaacgagaagguguacgacgacggcgcccccgagugcggcaucaccugcugguucaagaagagcggcgagugggugaugggcaucaucaacggcaacuggguggugcugaucgugcugugcgugcugcugcuguucagcuucauccugcugagcauccugugccccgugagaaagcacaagaagagcuga

SEQ ID NO: 8574 - RNA, 3402 nt, Artificial Sequence
  derived and/or modified CDS sequence (opt4) from SEOV(LongwanRn581)__GU592930.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccaacgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8575 - RNA, 3402 nt, Artificial Sequence
  derived and/or modified CDS sequence (opt4) from SEOV(RuianRn180)__GU592931.1__GP
auguggagccugcugaucguggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8576 - RNA, 3402 nt, Artificial Sequence
  derived and/or modified CDS sequence (opt4) from SEOV(ShuangyangRn470)__GU592925.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggagagcgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcaacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucguggagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaccugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8577 - RNA, 3402 nt, Artificial Sequence
  derived and/or modified CDS sequence (opt4) from SEOV(WuhanMm13)__JQ665886.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugaucgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccguggccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaccaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggaccauccugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgcccugugcgugcugcugcuguucagccugauccugcugagcauccugugccccgugagaaagcacaagaagagcuga

SEQ ID NO: 8578 - RNA, 3402 nt, Artificial Sequence
  derived and/or modified CDS sequence (opt4) from SEOV(WuhanMm24)__JQ665887.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugauggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcagauacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccagccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagccugaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgcccugugcgugcugcugcuguucagccugauccugcugagcauccugugccccgugagaaagcacaagaagagcuga

SEQ ID NO: 8579 - RNA, 3402 nt, Artificial Sequence
  derived and/or modified CDS sequence (opt4) from SEOV(WuhanRf02)__JQ665888.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugaucgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccguggccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagagaaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaccaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcguggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaacagcagacccgacggccugaccauguggacccugcugcugaucaucgagagcauccugugggccgccagcgccgccgagaucccccuggugccccugugggccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugcccaaguucagccagggcgacacccugcuguuccugggccccauggagggcggcggcaucaucuucaagcacuggugcaccagcaccugccacuucggcgaccccggcgacgugaugggccccaaggacaagcccuucaucagacccgaguuccccggccaguucagaaagaagugcaacuucgccaccacccccgugugcggcuacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgcccugugcgugcugcugcuguucagccugauccugcugagcauccugugccccgugagaaagcacaagaagagcuga

SEQ ID NO: 8580 - RNA, 3402 nt, Artificial Sequence
  derived and/or modified CDS sequence (opt4) from SEOV(WuhanRf07)__JQ665889.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugaucgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccguggccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaccaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagacccuacauccugaccauguggaccauccugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgcccugugcgugcugcugcuguucagccugauccugcugagcauccugugccccgugagaaagcacaagaagagcuga

SEQ ID NO: 8581 - RNA, 3402 nt, Artificial Sequence
  derived and/or modified CDS sequence (opt4) from SEOV(WuhanRf18)__JQ665893.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugaucgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccguggccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagagaaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaccaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggaccauccugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgcccugugcgugcugcugcuguucagccugauccugcugagcauccugugccccgugagaaagcacaagaagagcuga

SEQ ID NO: 8582 - RNA, 3402 nt, Artificial Sequence
  derived and/or modified CDS sequence (opt4) from SEOV(WuhanRn10)__JQ665896.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugaucgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccguggccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaccaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaacaagggcagcguggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggaccauccugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgcccugugcgugcugcugcuguucagccugauccugcugagcauccugugccccgugagaaagcacaagaagagcuga

SEQ ID NO: 8583 - RNA, 3402 nt, Artificial Sequence
  derived and/or modified CDS sequence (opt4) from SEOV(WuhanRn25)__JQ665897.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugaucgagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccguggccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaccaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaacaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggaccauccugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgcccugugcgugcugcugcuguucagccugauccugcugagcauccugugccccgugagaaagcacaagaagagcuga

SEQ ID NO: 8584 - RNA, 3402 nt, Artificial Sequence
  derived and/or modified CDS sequence (opt4) from SEOV(XiaotangshanRn7)__GU592929.1__GP
auguggagccugcuguuccuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaagaaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8585 - RNA, 3402 nt, Artificial Sequence
  derived and/or modified CDS sequence (opt4) from SEOV(YongjiaRf45)__GU592926.1__GP
auguggggccugcugcugcuggccgccauggugggccagggcagcgcccugaagaacguguucgacaugaagauccagugcccccacagcgugaacuucggcgagaccagcgugagcggcuacaccgagcugcccccccugccccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagagcgaggugagcuucaagggccugugcaugcugaagcacagaaugguggaggagagcuacagaaacagaagaagcgugaucugcuacgaccuggccugcaacaccaccuucugcaagcccaccguguacaugaucgugcccauccacgccugcaacaugaugaagagcugccugaucggccugggccccuacagaauccaggugaucuacgagagaaccuacugcagcaccggcauccugaccgagggcaagugcuucgugcacgacaagaccguggugagcgcccugaagagaggcauguacgccaucgccagcaucgagaccgugugcuucuucgugcaccagaagggcaacaccuacaagaucgugaccgccaucaccagcgccaugggcagcaagugcaacaacaccgacagcaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagguggccaccuaccagaucagcggccagaucgaggccaagaucccccacaccgugagcagcaagaaccugaagcugaccgccuucgccggcauccccagcuacagcagcaccagccugcuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccgugcugcuguuccugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggauccugcugcuggugaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugcuacuucgagaaggacuacgaguacgagaacagcugggccugcaacccccccgacugccccggcgugggcaucggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacguguucagcggcuacagaaaguuccuggccaccaucgacagcuuccagagcuucaacaccagcaacgugcacuucaccgacgagagaaucgaguggagagaccccgacggcaugcugagagaccacaucaacaucgugaucagcaaggacaucgacuucgagaaccuggccgacaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaacggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggaucgugcugaucgugcugugcgugcugcugcuguucagccugauccugcugagcauccugugccccgugagaaagcacaagaagagcuga

SEQ ID NO: 8586 - RNA, 3402 nt, Artificial Sequence
  derived and/or modified CDS sequence (opt4) from SEOV(YongjiaRn14)__GU592927.1__GP
auguggggccugcugcugcuggccgccauggugggccagggcagcgcccugaagaacguguucgacaugaagauccagugcccccacagcgugaacuucggcgagaccagcgugagcggcuacaccgagcugcccccccugccccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagagcgaggugagcuucaagggccugugcaugcugaagcacagaaugguggaggagagcuacagaaacagaagaagcgugaucugcuacgaccuggccugcaacaccaccuucugcaagcccaccguguacaugaucgugcccauccacgccugcaacaugaugaagagcugccugaucggccugggccccuacagaauccaggugaucuacgagagaaccuacugcaccaccggcauccugaccgagggcaagugcuucgugcccgacaaggccguggugagcgcccugaagagaggcauguacgccaucgccagcaucgagaccgugugcuucuucgugcaccagaagggcaacaccuacaagaucgugaccgccaucaccagcgccaugggcagcaagugcaacaacaccgacagcaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagguggccaccuaccagaucagcggccagaucgaggccaagaucccccacaccgugagcagcaagaaccugaagcugaccgccuucgccggcauccccagcuacagcagcaccagccugcuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccgugcugcuguuccugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggauccugcugcuggugaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacgugaucagcggcuacagaaaggugcuggccaccaucgacagcuuccagagcuucaacaccagcaacgugcacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaacggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggaucgugcugaucgugcugugcgugcugcugcuguucagccugauccugcugagcauccugugccccgugagaaagcacaagaagagcuga

SEQ ID NO: 8587 - RNA, 3402 nt, Artificial Sequence
  derived and/or modified CDS sequence (opt4) from SEOV(ZT10)__DQ159911.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaaguacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaucagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugcuacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggccugggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8588 - RNA, 3402 nt, Artificial Sequence
  derived and/or modified CDS sequence (opt4) from SEOV(ZT71)__EF117248.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccuggccgagggcaagugcuucgugcccgacaaggccguggugagcgcccugaagagaggcauguacgccaucgccagcaucgagaccaucugcuucuucauccaccagaagggcaacaaguacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccggccugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagacccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8589 - RNA, 3402 nt, Artificial Sequence
  derived and/or modified CDS sequence (opt4) from SEOV(DN2)__KX289953.1__GP
auguggagccugcugcugcuggccgcccuggccggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaaucgacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccugaucccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugagacccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaccaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8590 - RNA, 3402 nt, Artificial Sequence
  derived and/or modified CDS sequence (opt4) from SEOV(IR162)__KX079475.1__GP
auguggagccugcugcugcuggccgcccuggugggcagaggcuucacccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcgugcugaucgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccaccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcaucggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgaccuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8591 - RNA, 3402 nt, Artificial Sequence
  derived and/or modified CDS sequence (opt4) from SEOV(Gou3)__AF145977.2__GP
auguggggccugcugcugcuggccgcccuggugggccagggccuggcccugaagaacguguucgacaugaagauccagugcccccacagcgugaacuucggcgagaccagcgugagcggcuacaccgagcugcccccccugccccugcaggaggccgagcagcuggugcccgagagcagcugcaacauggacaaccaccagagccugagcaccaucaacaagcugaccaaggugaucuggagaaagaaggccaaccaggagagcgccagccagaacagcuucgaggugguggagaacgaggugagcuucaagggccugugcaugcugaagcacagaaugguggaggagagcuacagaaacagaagaagcgugaucugcuacgaccuggccugcaacaccaccuucugcaagcccaccguguacaugaucgugcccauccacgccugcaacaugaugaagagcugccugaucggccugggccccuacagaauccaggugaucuacgagagaaccuacugcaccaccggcauccugaccgagggcaagugcuucgugcccgacaaggccguggugagcgcccugaagagaggcauguacgccaucgccagcaucgagaccaucugcuucuucgugcacaagaagggcaacaccuacaagaucgugagcgccaucacccuggccaugggcagcaagugcaacaacaccgacagcaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccauccaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucgugguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcuggugaccuucugcuucggcugggugcugauccccgccugcacccuggccgugcugcuguuccugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggauccugcugcuggugaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcgccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacgugaucagcggcuacagaaaggugcuggccaccaucgacagcuuccagagcuucaacaccagcaacgugcacuucaccgacgagagaaucgaguggaaggaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucgaggccugcgacauggccaucugcuacggcgccgagagcgugacccugagcagaggccagaacaccaucaagaucaccggcaagggcggccacagcggcagcagcuucaagugcugccacggcaaggagugcagcgccaacggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8592 - RNA, 3402 nt, Artificial Sequence
  derived and/or modified CDS sequence (opt4) from SEOV(HB55)__AF035832.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugguguggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugggcgcccugaagagaggcauguacgccaucgccagcaucgagaccaucugcuucuucauccaccagaagggcaacaaguacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaucgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggccugcgugcaguucggcgaggaguaccugugcaagaccaucgacaugaacgacugcuucgugaccggccacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccaucugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugagaaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8593 - RNA, 3402 nt, Artificial Sequence
  derived and/or modified CDS sequence (opt4) from SEOV(L99)__AF035833.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugguguggagaaagaaggccaaccaggagcuggccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaucgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugacccccaagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucagcugccccgaguuccccggccaguucagaaagaagugcaacuucgccaccacccccaucugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugagaaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcgugaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8594 - RNA, 3402 nt, Artificial Sequence
  derived and/or modified CDS sequence (opt4) from SEOV(Z37)__AF187081.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaaguacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaucagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugccaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcaccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8595 - RNA, 3402 nt, Artificial Sequence
  derived and/or modified CDS sequence (opt4) from SEOV(Z37)__AF190119.1__GP
auguggagccugcugcugcuggccgcccuggugggccagggcuucgcccugaagaacguguucgacaugagaauccagugcccccacagcgugaacuucggcgagaccagcgugagcggcuacaccgagcugcccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucaucugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgacgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggaguaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguucgccggccaguucagaaagaagugcaacuucgccaccacccccgugugcgaguacgacggcaacaucaucagcggcuacaagaaggugcuggagaccaucgacagcuuccagagcuucaacaccagcaacauccacuucaccgacgagagaaucgaguggagagaccccgacggcaugcugagagaccacaucaacaucgugaucagcaaggacaucgacuucgagaacauggccgagaaccccugcaaggugggccugcaggccgccaacaucgagggcgccuggggcagcggcgugggcuucacccugaccugccaggugagccugaccgagugccccaccagccugaccagcaucaaggccugcgacauggccaucugcuacggcgccgagagcgugacccugagcagaggccagaacaccgugaagaucaccggcaagggcggccacagcggcagcagcuucaagagaugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8596 - RNA, 3402 nt, Artificial Sequence
  derived and/or modified CDS sequence (opt4) from SEOV__M34882.1__GP
auguggagccugcugcugcuggccgcccuggugggccagggcuucgcccugaagaacguguucgacaugagaauccagcugccccacagcgugaacuucggcgagaccagcgugagcggcuacaccgaguuccccccccugagccugcaggaggccgagcagcuggugcccgagagcagcugcaacauggacaaccaccagagccugagcaccaucaacaagcugaccaaggugaucuggagaaagaaggccaaccaggagagcgccaaccagaacagcuucgaggugguggagagcgaggugagcuucaagggccugugcaugcugaagcacagaaugguggaggagagcuacagaaacagaagaagcgugaucugcuacgaccuggccugcaacagcaccuucugcaagcccaccguguacaugaucgugcccauccacgccugcaacaugaugaagagcugccugaucggccugggccccuacagaauccaggugguguacgagagaaccuacugcaccaccggcauccugaccgagggcaagugcuucgugcccgacaaggccguggugagcgcccugaagagaggcauguacgccaucgccagcaucgagaccaucugcuucuucauccaccagaagggcaacaccuacaagaucgugaccgccaucaccagcgccaugggcagcaagugcaacaacaccgacaccaaggugcagggcuacuacaucugcaucaucggcggcaacagcgcccccguguacgcccccgccggcgaggacuucagagccauggagguguucagcggcaucaucaccagcccccacggcgaggaccacgaccugcccggcgaggagaucgccaccuaccagaucagcggccagaucgaggccaagaucccccacaccgugagcagcaagaaccugaagcugaccgccuucgccggcauccccagcuacagcagcaccagcauccuggccgccagcgaggacggcagauucaucuucagccccggccuguuccccaaccugaaccagagcgugugcgacaacaacgcccugccccugaucuggagaggccugaucgaccugaccggcuacuacgaggccgugcaccccugcaacguguucugcgugcugagcggccccggcgccagcugcgaggccuucagcgagggcggcaucuucaacaucaccagccccaugugccuggugagcaagcagaacagauucagagccgccgagcagcagaucagcuucgugugccagagaguggacauggacaucaucguguacugcaacggccagaagaagaccauccugaccaagacccuggugaucggccagugcaucuacaccaucaccagccuguucagccugcugcccggcguggcccacagcaucgccaucgagcugugcgugcccggcuuccacggcugggccaccgccgcccugcugaucaccuucugcuucggcugggugcugauccccgccugcacccuggccauccugcuggugcugaaguucuucgccaacauccugcacaccagcaaccaggagaacagauucaaggccauccugagaaagaucaaggaggaguucgagaagaccaagggcagcauggugugcgagaucugcaaguacgagugcgagacccugaaggagcugaaggcccacaaccugagcugcgugcagggcgagugccccuacugcuucacccacugcgagcccaccgagaccgccauccaggcccacuacaaggugugccaggccacccacagauucagagaggaccugaagaagaccgugaccccccagaacaucggccccggcugcuacagaacccugaaccuguucagauacaagagcagaugcuacauccugaccauguggacccugcugcugaucaucgagagcauccugugggccgccagcgccgccgagaucccccuggugccccuguggaccgacaacgcccacggcgugggcagcgugcccaugcacaccgaccuggagcuggacuucagccugcccagcagcagcaaguacaccuacaagagacaccugaccaaccccgugaacgaccagcagagcgugagccugcacaucgagaucgagagccagggcaucggcgccgccgugcaccaccugggccacugguacgacgccagacugaaccugaagaccagcuuccacugcuacggcgccugcaccaaguaccaguaccccuggcacaccgccaagugccacuucgagaaggacuacgaguacgagaacagcugggccugcaacccccccgacugccccggcgugggcaccggcugcaccgccugcggccuguaccuggaccagcugaagcccgugggcaccgccuucaagaucaucagcgugagauacagcagaaaggugugcgugcaguucggcgaggagcaccugugcaagaccaucgacaugaacgacugcuucgugaccagacacgccaagaucugcaucaucggcaccgugagcaaguucagccagggcgacacccugcuguuccugggccccauggagggcggcggcaucaucuucaagcacuggugcaccagcaccugccacuucggcgaccccggcgacgugaugggccccaaggacaagcccuucaucugccccgaguuccccggccaguucagaaagaagugcaacuucgccaccacccccgugugcgaguacgacggcaacaucaucagcggcuacaagaaggugcuggccaccaucgacagcuuccagagcuucaacaccagcaacauccacuucaccgacgagagaaucgaguggagagaccccgacggcaugcugagagaccacaucaacaucgugaucagcaaggacaucgacuucgagaaccuggccgagaaccccugcaaggugggccugcaggccgccaacaucgagggcgccuggggcagcggcgugggcuucacccugaccugcaaggugagccugaccgagugccccaccuuccugaccagcaucaaggccugcgacauggccaucugcuacggcgccgagagcgugacccugagcagaggccagaacaccgugaagaucaccggcaagggcggccacagcggcagcagcuucaagugcugccacggcaaggagugcagcagcaccggccugcaggccagcgccccccaccuggacaaggugaacggcaucagcgagcuggagaacgagaagguguacgacgacggcgcccccgagugcggcaucaccugcugguucaagaagagcggcgagugggugaugggcaucaucaacggcaacuggguggugcugaucgugcugugcgugcugcugcuguucagccugauccugcugagcauccugugccccgugagaaagcacaagaagagcuga

SEQ ID NO: 8597 - RNA, 3423 nt, Artificial Sequence
  derived and/or modified CDS sequence (opt4) from SNV(NM H10)__NC_005215.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaucacccccauccugcugacccagguggccgaccugaagaucgagagcagcugcaacuucgaccugcacgugcccgccaccaccacccagaaguacaaccagguggacuggaccaagaagagcagcaccaccgagagcaccaacgccggcgccaccaccuucgaggccaagaccaaggagaucaaccugaagggcaccugcaacaucccccccaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugaucgagggccugugcuucauccccacccacaccaucgcccugacccagcccggccacaccuacgacaccaugacccugcccgugaccugcuuccugguggccaagaagcugggcacccagcugaagcuggccguggagcuggagaagcugaucaccggcgugagcugcaccgagaacagcuuccagggcuacuacaucugcuucaucggcaagcacagcgagccccuguucgugcccaccauggaggacuacagaagcgccgagcuguucaccagaauggugcugaaccccagaggcgaggaccacgaccccgaccagaacggccagggccugaugagaaucgccggccccgugaccgccaaggugcccagcaccgagaccaccgagaccaugcagggcaucgccuucgccggcgcccccauguacagcagcuucagcacccuggugagaaaggccgaccccgaguacguguucagccccggcaucaucgccgagagcaaccacagcgugugcgacaagaagaccgugccccugaccuggaccggcuuccuggccgugagcggcgagaucgagaagaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccgccgugacccugaucauccugaagauccugagacugcugaccuucagcugcagccacuacagcaccgagagcaaguucaaggugauccuggagagagugaagguggaguaccagaagaccaugggcagcauggugugcgacaucugccaccacgagugcgagaccgccaaggagcuggagacccacaagaagagcugccccgagggccagugccccuacugcaugaccaucaccgagagcaccgagagcgcccugcaggcccacuucgccaucugcaagcugaccaacagauuccaggagaaccugaagaagagccugaagagacccgaggugagaaagggcugcuacagaacccugggcguguucagauacaagagcagaugcuacgugggccugguguggggcauccugcugaccaccgagcugaucaucugggccgccagcgccgacaccccccugauggagagcggcuggagcgacaccgcccacggcgugggcaucauccccaugaagaccgaccuggagcuggacuucgcccuggccagcagcagcagcuacagcuacagaagaaagcuggugaaccccgccaaccaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccaucagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccgugagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccgugagaagcagaaagaacaaggccaacuga

SEQ ID NO: 8598 - RNA, 3423 nt, Artificial Sequence
  derived and/or modified CDS sequence (opt4) from SNV(1)__JQ690283.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaccacccccauccugcugacccagguggccgaccugaagaucgagagcagcugcaacuucgaccugcacgugcccgccaccaccacccagaaguacaaccagguggacuggaccaagaagagcagcaccaccgagagcaccaacgccggcgccgccaccuucgaggccaagaccaaggaggugaaccugaagggcaccugcaacaucccccccaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugaucgagggccugugcuucauccccacccacaccaucgcccugacccagcccggccacaccuacgacaccaugacccugcccgugaccugcuuccugguggccaagaagcugggcacccagcugaagcuggccguggagcuggagaagcugaucaccggcgugagcugcaccgagaacagcuuccagggcuacuacaucugcuucaucggcaagcacagcgagccccuguucgugcccaccauggaggacuacagaagcgccgagcuguucaccagaauggugcugaaccccagaggcgaggaccacgaccccgaccagaacggccagggccugaugagaaucgccggccccgugaccgccaaggugcccagcaccgagaccaccgagaccaugcagggcaucgccuucgccggcgcccccauguacagcagcuucagcacccuggugagaaaggccgaccccgaguacguguucagccccggcaucaucgccgagagcaaccacagcgugugcgacaagaagaccgugccccugaccuggaccggcuuccuggccgugagcggcgagaucgagagaaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccgugacccugaucauccugaaggugcugagacugcugaccuucagcugcagccacuacagcaccgagagcaaguucaaggugauccuggagagagugaagguggaguaccagaagaccaugggcagcauggugugcgacaucugccaccacgagugcgagaccgccaaggagcuggagacccacaagaagagcugccccgagggccagugccccuacugcaugaccaucaccgagagcaccgagagcgcccugcaggcccacuucagcaucugcaagcugaccaacagauuccaggagaaccugaagaagagccugaagagacccgaggugagaaagggcugcuacagaacccugggcguguucagauacaagagcagaugcuacgugggccugguguggggcauccugcugaccaccgagcugaucaucugggccgccagcgccgacaccccccugauggagagcggcuggagcgacaccgcccacggcgugggcaucauccccaugaagaccgaccuggagcuggacuucgcccuggccagcagcagcagcuacagcuacagaagaaagcuggugaaccccgccaaccaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccaucagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccgugagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccgugagaaacagaaagaacaaggccaacuga

SEQ ID NO: 8599 - RNA, 3423 nt, Artificial Sequence
  derived and/or modified CDS sequence (opt4) from SNV(1)__JQ690279.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaccacccccauccugcugacccagguggccgaccugaagaucgagagcagcugcaacuucgaccugcacgugcccgccaccaccacccagaaguacaaccagguggacuggaccaagaagagcagcaccaccgagagcaccaacgccggcgccaacaccuucgaggccaagaccaaggagaucaaccugaagggcaccugcaacaucccccccaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugaucgagggccugugcuucauccccacccacaccaucgcccugacccagcccggccacaccuacgacaccaugacccugcccgugaccugcuuccugguggccaagaagcugggcacccagcugaagcuggccguggagcuggagaagcugaucaccggcgugagcugcaccgagaacagcuuccagggcuacuacaucugcuucaucggcaagcacagcgagccccuguucgugcccaccauggaggacuacagaagcgccgagcuguucaccagaauggugcugaaccccagaggcgaggaccacgaccccgaccagaacggccagggccugaugagaaucgccggccccgugaccgccaaggugcccagcaccgagaccaccgagaccaugcagggcaucgccuucgccggcgcccccauguacagcagcuucagcacccuggugagaaaggccgaccccgaguacguguucagccccggcaucaucgccgagagcaaccacagcgugugcgacaagaagaccgugccccugaccuggaccggcuuccuggccgugagcggcgagaucgagagaaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccgugacccugcugauccugaagauccugagacugcugaccuucagcugcagccacuacagcaccgagagcaaguucaaggugauccuggagagagugaagguggaguaccagaagaccaugggcagcauggugugcgacaucugccaccacgagugcgagaccgccaaggagcuggagacccacaagaagagcugccccgagggccagugccccuacugcaugaccaucaccgagagcaccgagagcgcccugcaggcccacuucagcaucugcaagcugaccaacagauuccaggagaaccugaagaagagccugaagagacccgaggugaagaagggcugcuacagaacccugggcguguucagauacaagagcagaugcuacgugggccugguguggggcauccugcugaccaccgagcugaucaucugggccgccagcgccgacaccccccugauggagagcggcuggagcgacaccgcccacggcgugggcaucauccccaugaagagcgaccuggagcuggacuucgcccuggccagcagcagcagcuacagcuacagaagaaagcuggugaaccccgccaaccaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccaucagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccgugagcggcuuccagagaaugauggccaccagagacagcuuccagagcuucaacgugaccgagccccacaucaccagcaacagacuggaguggaucgaccccgacagcagcaucaaggaccacaucaacaugauccugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccgugagaagcagaaagaacaaggccaacuga

SEQ ID NO: 8600 - RNA, 3423 nt, Artificial Sequence
  derived and/or modified CDS sequence (opt4) from SNV(2)__JQ690284.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaccacccccauccugcugacccagguggccgaccugaagaucgagagcagcugcaacuucgaccugcacgugcccgccaccaccacccagaaguacaaccagguggacuggaccaagaagggcagcaccaccgagagcaccaacgccggcgccaacaccuucgaggccaagaccaaggaggugaaccugaagggcaccugcaacaucccccccaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugaucgagggccugugcuucauccccacccacaccaucgcccugacccagcccggccacaccuacgacaccaugacccugcccgugaccugcuuccugguggccaagaagcugggcacccagcugaagcuggccguggagcuggagaagcugaucaccggcgugagcugcaccgagaacagcuuccagggcuacuacaucugcuucaucggcaagcacagcgagccccuguucgugcccaccauggaggacuacagaagcgccgagguguucaccagaauggugcugaaccccagaggcgaggaccacgaccccgaccagaacggccagggccugaugagaaucgccggccccgugaccgccaaggugcccagcaccgagaccaccgagaccaugcagggcaucgccuucgccggcgcccccauguacagcagcuucagcacccuggugagaaaggccgaccccgaguacguguucagccccggcaucaucgccgagagcaaccacagcgugugcgacaagaagaccgugccccugaccuggaccggcuuccuggccgugagcggcgagaucgagagaaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccgugacccugaucauccugaagauccugagacugcugaccuucagcugcagccacuacagcaccgagagcaaguucaaggugauccuggagagagugaagguggaguaccagaagaccaugggcagcauggugugcgacaucugccaccacgagugcgagaccgccaaggagcuggagacccacaagaagagcugccccgagggccagugccccuacugcaugaccaucaccgagagcaccgagagcgcccugcaggcccacuucagcaucugcaagcugaccaacagauuccaggagaaccugaagaagagccugaagagacccgaggugaagaagggcugcuacagaacccugggcguguucagauacaagagcagaugcuacgugggccugguguggggcauccugcugaccaccgagcugaucaucugggccgccagcgccgacaccccccugauggagagcggcuggagcgacaccgcccacggcgugggcaucauccccaugaagaccgaccuggagcuggacuucgcccuggccagcagcagcagcuacagcuacagaagaaagcuggugaaccccgccaaccaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccaucagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccgugagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccgugagaagcagaaagaacaaggccaacuga

SEQ ID NO: 8601 - RNA, 3423 nt, Artificial Sequence
  derived and/or modified CDS sequence (opt4) from SNV(2)__JQ690280.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaccacccccauccugcugacccagguggccgaccugaagaucgagagcagcugcaacuucgaccugcacgugcccgccaccaccacccagaaguacaaccagguggacuggaccaagaagagcagcaccaccgagagcaccaacgccggcgccaacaccuucgaggccaagaccaaggaggugaaccugaagggcaccugcaacaucccccccaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugaucgagggccugugcuucauccccacccacaccaucgcccugacccagcccggccacaccuacgacaccaugacccugcccgugaccugcuuccugguggccaagaagcugggcacccagcugaagcuggccguggagcuggagaagcugaucaccggcgugagcugcaccgagaacagcuuccagggcuacuacaucugcuucaucggcaagcacagcgagccccuguucgugcccaccauggaggacuacagaagcgccgagcuguucaccagaauggugcugaaccccagaggcgaggaccacgaccccgaccagaacggccagggccugaugagaaucgccggccccgugaccgccaaggugcccagcaccgagaccaccgagaccaugcagggcaucgccuucgccggcgcccccauguacagcagcuucagcacccuggugagaaaggccgaccccgaguacguguucagccccggcaucaucgccgagagcaaccacagcgugugcgacaagaagaccgugccccugaccuggaccggcuuccuggccgugagcggcgagaucgagagaaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccgugacccugaucauccugaagauccugagacugcugaccuucagcugcagccacuacagcaccgagagcaaguucaaggugauccuggagagagugaagguggaguaccagaagaccaugggcagcauggugugcgacaucugccaccacgagugcgagaccgccaaggagcuggagacccacaagaagagcugccccgagggccagugccccuacugcaugaccaucaccgagagcaccgagagcgcccugcaggcccacuucagcaucugcaagcugaccaacagauuccaggagaaccugaagaagagccugaagagacccgaggugaagaagggcugcuacagaacccugggcguguucagauacaagagcagaugcuacgugggccugguguggggcauccugcugaccaccgagcugaucaucugggccgccagcgccgacaccccccugauggagagcggcuggagcgacaccgcccacggcgugggcaucauccccaugaagaccgaccuggagcuggacuucgcccuggccagcagcagcagcuacagcuacagaagaaagcuggugaaccccgccaaccaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccaucagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccgugagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccgugagaagcagaaagaacaaggccaacuga

SEQ ID NO: 8602 - RNA, 3423 nt, Artificial Sequence
  derived and/or modified CDS sequence (opt4) from SNV(CC107/POR)__KT885045.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaccacccccauccugcugacccagguggccgaccugaagaucgagagcagcugcaacuucgaccugcacgugcccgccaccaccacccagaaguacaaccagguggacuggaccaagaagagcagcaccaccgagagcaccaacgccggcgccaccaccuucgaggccaagaccaaggaggugaaccugaagggcaccugcaacaucccccccaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugaucgagggccugugcuucauccccacccacaccaucgcccugacccagcccggccacaccuacgacaccaugacccugcccgugaccugcuuccugguggccaagaagcugggcacccagcugaagcuggccguggagcuggagaagcugaucaccggcgugagcugcaccgagaacagcuuccagggcuacuacaucugcuucaucggcaagcacagcgagccccuguucgugcccaccauggaggacuacagaagcgccgagcuguucaccagaauggugcugaaccccagaggcgaggaccacgaccccgaccagaacggccagggccugaugagaaucgccggccccgugaccgccaaggugcccagcaccgagaccaccgagaccaugcagggcaucgccuucgccggcgcccccauguacagcagcuucagcacccuggugagaaaggccgaccccgaguacguguucagccccggcaucaucgccgagagcaaccacagcgugugcgacaagaagaccgugccccugaccuggaccggcuuccuggccgugagcggcgagaucgagagaaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccgugacccugaucauccugaagauccugagacugcugaccuucagcugcagccacuacagcaccgagagcaaguucaaggugauccuggagagagugaagguggaguaccagaagaccaugggcagcauggugugcgacaucugccaccacgagugcgagaccgccaaggagcuggagacccacaagaagagcugccccgagggccagugccccuacugcaugaccaucaccgagagcaccgagagcgcccugcaggcccacuucagcaucugcaagcugaccaacagauuccaggagaaccugaagaagagccugaagagacccgaggugagaaagggcugcuacagaacccugggcguguucagauacaagagcagaugcuacgugggccugguguggggcauccugcugaccaccgagcugaucaucugggccgccagcgccgacaccccccugauggagagcggcuggagcgacaccgcccacggcgugggcaucgugcccaugaagaccgaccuggagcuggacuucgcccuggccagcagcagcagcuacagcuacagaagaaagcuggugaaccccgccaaccaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccaucagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccgugagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccgugagaaacagaaagaacaaggccaacuga

SEQ ID NO: 8603 - RNA, 3423 nt, Artificial Sequence
  derived and/or modified CDS sequence (opt4) from HPS(Convict Creek 107)__L33474.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaccacccccauccugcugacccagguggccgaccugaagaucgagagcagcugcaacuucgaccugcacgugcccgccaccaccacccagaaguacaaccagguggacuggaccaagaagagcagcaccaccgagagcaccaacgccggcgccaccaccuucgaggccaagaccaaggaggugaaccugaagggcaccugcaacaucccccccaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugaucgagggccugugcuucauccccacccacaccaucgcccugacccagcccggccacaccuacgacaccaugacccugcccgugaccugcuuccugguggccaagaagcugggcacccagcugaagcuggccguggagcuggagaagcugaucaccggcgugagcugcaccgagaacagcuuccagggcuacuacaucugcuucaucggcaagcacagcgagccccuguucgugcccaccauggaggacuacagaagcgccgagcuguucaccagaauggugcugaaccccagaggcgaggaccacgaccccgaccagaacggccagggccugaugagaaucgccggccccgugaccgccaaggugcccagcaccgagaccaccgagaccaugcagggcaucgccuucgccggcgcccccauguacagcagcuucagcacccuggugagaaaggccgaccccgaguacguguucagccccggcaucaucgccgagagcaaccacagcgugugcgacaagaagaccgugccccugaccuggaccggcuuccuggccgugagcggcgagaucgagagaaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccgugacccugaucauccugaagauccugagacugcugaccuucagcugcagccacuacagcaccgagagcaaguucaaggugauccuggagagagugaagguggaguaccagaagaccaugggcagcauggugugcgacaucugccaccacgagugcgagaccgccaaggagcuggagacccacaagaagagcugccccgagggccagugccccuacugcaugaccaucaccgagagcaccgagagcgcccugcaggcccacuucagcaucugcaagcugaccaacagauuccaggagauccugaagaagagccugaagagacccgaggugagaaagggcugcuacagaacccugggcguguucagauacaagagcagaugcuacgugggccugguguggggcauccugcugaccaccgagcugaucaucugggccgccagcgccgacaccccccugauggagagcggcuggagcgacaccgcccacggcgugggcaucgugcccaugaagaccgaccuggagcuggacuucgcccuggccagcagcagcagcuacagcuacagaagaaagcuggugaaccccgccaaccaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccaucagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccgugagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccagaagcggcgaguggcugcugggcauccugaacggcaacuggguggugguggccgugcugaucgugauccugauccugagcauccugcuguucagcuucuucugccccgugagaaacagaaagaacaaggccaacuga

SEQ ID NO: 8604 - RNA, 3423 nt, Artificial Sequence
  derived and/or modified CDS sequence (opt4) from HPS(Convict Creek 74)__L33684.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaccacccccauccugcugacccagguggccgaccugaagaucgagagcagcugcaacuucgaccugcacgugcccgccaccaccacccagaaguacaaccagguggacuggaccaagaagagcagcaccaccgagagcaccaacgccggcgccaccaccuucgaggccaagaccaaggaggugaaccugaagggcaccugcaacaucccccccaccaccuucgaggccgccuucaagagcagaaagaccgugaucugcuacgaccuggccugcaaccagacccacugccugcccaccgugcaccugaucgcccccgugcagaccugcaugagcgugagaagcugcaugaucggccugcugagcagcagaauccaggugaucuacgagaagaccuacugcgugaccggccagcugaucgagggccugugcuucauccccacccacaccaucgcccugacccagcccggccacaccuacgacaccaugacccugcccgugaccugcuuccugguggccaagaagcugggcacccagcugaagcuggccguggagcuggagaagcugaucaccggcgugagcugcaccgagaacagcuuccagggcuacuacaucugcuucaucggcaagcacagcgagccccuguucgugcccaccauggaggacuacagaagcgccgagcuguucaccagaauggugcugaaccccagaggcgaggaccacgaccccgaccagaacggccagggccugaugagaaucgccggccccgugaccgccaaggugcccagcaccgagaccaccgagaccaugcagggcaucgccuucgccggcgcccccauguacagcagcuucagcacccuggugagaaaggccgaccccgaguacguguucagccccggcaucaucgccgagagcaaccacagcgugugcgacaagaagaccgugccccugaccuggaccggcuuccuggccgugagcggcgagaucgagagaaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugauccccggcguggcccacagccuggccguggagcugugcgugcccggccugcacggcugggccaccaccgcccugcugaucaccuucugcuucggcuggcugcugauccccaccgugacccugaucauccugaagauccugagacugcugaccuucagcugcagccacuacagcaccgagagcaaguucaaggugauccuggagagagugaagguggaguaccagaagaccaugggcagcauggugugcgacaucugccaccacgagugcgagaccgccaaggagcuggagacccacaagaagagcugccccgagggccagugccccuacugcaugaccaucaccgagagcaccgagagcgcccugcaggcccacuucagcaucugcaagcugaccaacagauuccaggagauccugaagaagagccugaagagacccgaggugagaaagggcugcuacagaacccugggcguguucagauacaagagcagaugcuacgugggccugguguggggcauccugcugaccaccgagcugaucaucugggccgccagcgccgacaccccccugauggagagcggcuggagcgacaccgcccacggcgugggcaucgugcccaugaagaccgaccuggagcuggacuucgcccuggccagcagcagcagcuacagcuacagaagaaagcuggugaaccccgccaaccaggaggagacccugcccuuccacuuccagcuggacaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccaucagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccgugagcggcuuccagagaaugauggccaccagagacagcuuccagagcuucaacgugaccgagccccacaucaccagcaacagacuggaguggaucgaccccgacagcagcaucaaggaccacaucaacauggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgacagcgccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaagguguacgacgacggcgccccccccugcaccaucaagugcugguucaccaagagcggcgaguggcugcugggcauccugaacggcaacuggguggugguggccgugcugaucgugauccugauccugagcauccugcuguucagcuucuucugccccgugagaaacagaaagaacaaggccaacuga

SEQ ID NO: 8605 - RNA, 3423 nt, Artificial Sequence
  derived and/or modified CDS sequence (opt4) from BRV(Indiana)__AF030551.1__GP
auggugggcugggugugcaucuuccugguggugcugaccaccgccaccgccggccugaccagaaaccuguacgagcugaagaucgagugcccccacaccgugggccugggccagggcuacgugaccggcagcguggagaccacccccgugccccugggccaggugaccgaccugaagaucgagagcagcugcaacuucgaccugcacgugcccagcaccaccauccagaaguacaaccagguggagugggccaagaagaccagcaccaccgagagcaccaacgccggcgccagcaccuucgaggccaagaccaaggaggugaaccugaagggcaccugcaacauccccgugaccaccuucgaggccgccuacaagagcagaaagaccgugaucugcuacgaccuggccugcaaccagacccacugccugcccaccgugcaccugaucgcccccgugcagaccugcaugagcgugagaagcugcaugaucggccugcugagcagcagaauccacgugaucuacgagaagaccuacugcgugaccggccaggugguggagggccugugcuucauccccacccacaccaucgcccugacccagcccggccacaccuacgacaccaugacccugcccaucaccugcuuccugguggccaagaagcugggcacccagcugaagaucgccguggagcuggagaagcugaucaccgccagcggcugcaccgagaacagcuuccagggcuacuacaucugcuuccugggcaagcacagcgagccccuguacgugcccaccauggacgacuacagaagcgccgagcuguucaccagaauggugcugaaccccaagggcgaggaccacgaccccgaccaggacggccagggccugaugagaaucaccggccccaucaccgccaaggugcccagcaccgagaccaccgagaccaugcagggcguggccuucgccggcacccccauguacagcagcuucagcacccugcugagaaaggccgaccccgaguacguguucagccccggcaucauccccgagagcaaccacagcgugugcgacaagaagaccaugcccaucaccuggaccggcuuccuggccgugagcggcgagaucgagaagaucaccggcugcaccguguucugcacccuggccggccccggcgccagcugcgaggccuacagcgagaccggcaucuucaacaucagcagccccaccugccuggugaacaaggugcagaaguucagaggcagcgagcagagagugaacuucaugugccagagaguggaccaggacguggugguguacugcaacggccagaagaaggugauccugaccaagacccuggugaucggccagugcaucuacaccuucaccagccuguucagccugcugcccggcguggcccacagccuggccguggagcugugcgugcccggccugcacggcugggccaccaccgcccugcugaucaccuucugcuucggcuggcugcugauccccagcgugacccugaucauccugagaauccugagacugcugaccuucagcugcagccacuacagcaccgagagcaaguucaagauccugcuggagaaggugaagguggaguaccagaagaccaugggcagcauggugugcgacaucugccaccacgagugcgagaccgccaaggagcuggacacccacagaaagagcugccccgagggccagugccccuacugcaugaccaugaccgagagcaccgagagcgcccugcaggcccacuucagcgugugcaagcugaccaacagauuccaggagaaccugaagaagagccugaagcaccccgaggugaagcagggcugcuacagaacccugggcguguucagauacaagagcagaugcuacgugggccugguguggggcauccugcugaccgccgagcugaucaucugggccgccagcgccgagaccccccugauggagagcggcuggagcgacaccgcccacggcgugggcaucgugcccaugaagaccgaccuggagcuggacuucgcccuggccagcagcagcagcuacagcuacagaagaaagcuggugaaccccgccaacagcgaggagacccugcccuuccaccugcagcuggagaagcagguggugcacgccgagauccacaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcuggaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugacccccagcgugaaggugugcaugaucggcaccgugagcaagcugcagcccggcgacacccugcuguuccugggcccccuggagcagggcggcaucauccugaagcaguggugcaccaccagcugcguguucggcgaccccggcgacaucaugagcaccaccagcggcaugaagugccccgagcacaccggcagcuucagaaagaucugcggcuucgccaccacccccaccugcgaguaccagggcaacaccgugagcggcuucaagagaaugauggccaccagagacagcuuccagagcuucaacgugaccgagccccacaucaccagcaacagacuggaguggaucgaccccgacagcagcaucaaggaccacaucaacguggugcugaacagagacgugagcuuccaggaccugagcgacaaccccugcaagguggaccugcacacccagagcaucgacggcgccuggggcagcggcgugggcuucacccuggugugcaccgugggccugaccgagugcgccaacuucaucaccagcaucaaggccugcgaccuggccaugugcuacggcgccaccgugaccaaccugcugagaggcagcaacaccgugaagguggugggcaagggcggccacagcggcagccuguucaagugcugccacgacaccgacugcaccgacgagggccuggccgccagccccccccaccuggacagagugaccggcuucaaccagaucgacagcgacaagguguacgacgacggcgccccccccugcagcgugaagugcugguucaccaagagcggcgaguggcugcugagaauccugaacggcaacuggauggugguggccgugcugaucgugauccugauccugagcauccugcuguucagcuucuucugccccaucagaagcagaaagagcaagcccaacuga

SEQ ID NO: 8606 - RNA, 3423 nt, Artificial Sequence
  derived and/or modified CDS sequence (opt4) from BRV(Oklahoma)__AF030552.1__GP
auggugggcugggugugcaucuuccugguggugcugaccaccagcaccgccggccugaccagaaaccuguacgagcugaagaucgagugcccccacaccgugggccugggccagggcuacgugaccggcagcguggagaucacccccgugccccugggccaggugaccgaccugaagaucgagagcagcugcaacuucgaccugcacgugcccagcaccaccauccagaaguacacccagguggagugggccaagaagagcagcaccaccgagagcaccaacgccgccgccaccaccuucgaggccaagaccaaggaggugagccugaagggcaccugcaacauccccgugaccaccuucgaggccgccuacaagagcagaaagaccgugaucugcuacgaccuggccugcaaccagacccacugccugcccaccgugcaccugaucgcccccgugcagaccugcaugagcgugagaagcugcauggugggccugcugagcagcagaauccaggugaucuacgagaagaccuacugcgugaccggccagcugguggagggccugugcuucauccccacccacaccaucgcccugacccagcccggccacaccuacgacaccaugacccugcccaucaccugcuuccugguggccaagaagcugggcacccagcugaagaucgccguggagcuggagaagcugaucaccgccagcggcugcaccgagaacagcuuccagggcuacuacaucugcuuccugggcaagcacagcgagcccauguacgugcccaccauggacgacuacagaagcgccgagcuguucaccagaauggugcugaaccccaagggcgaggaccacgaccccgaccagaacggccagggccugaugagaaucgccggccccaucaccgccaaggugcccagcaccgagaccaccgagaccaugcagggcaucgccuucgccggcgcccccauguacagcaccuucgccacccuggugagaaaggccgaccccgaguacguguucagccccggcaucauccccgagagcaaccacagcgugugcgacaagaagaccaugcccaucaccuggaccggcuuccuggcccugagcggcgagaucgagagaaucaccggcugcaccguguucugcacccuggccggccccggcgccagcugcgaggccuacagcgagaccggcaucuucaacaucagcagccccaccugccuggugaacaaggugcagaaguucagaggcagcgagcagagaaucaacuucaugugccagagaguggaccaggacguggugguguacugcaacggccagaagaaggugauccugaccaagacccuggugaucggccagugcaucuacaccuucaccagccuguucagccugcugcccggcguggcccacagccuggccguggagcugugcgugcccggccugcacggcugggccaccaccgcccugcugaucaccuucugcuucggcuggcugcugauccccgccaucacccugaucgugcugaagauccugagacugcugaccuucagcugcagccacuacagcaaggagagcagauucaagauccugcuggagaaggugaagguggaguaccagaagaccaugggcagcauggugugcgacaucugccaccacgacugcgagaccgccaaggagcuggacacccacaagaagagcugccccgagggccagugccccuacugcaugaccaugaccgagagcaccgagagcgcccugcaggcccacuucagcgugugcaagcugaccaacagauuccaggagaaccugaagaagagccugaagcaccccgaggugaagcagggcugcuacagaacccugggcguguucagauacaagagcagaugcuacgugggccugguguggggccugcugcugaccaccgagcugaucaucugggccgccagcgccgagaccccccugauggagagcggcuggagcgacaccgcccacggcgugggcaucgugcccaugagaaccgaccuggagcuggacuucgcccuggccagcagcagcagcuacagcuacagaagaaagcuggugaaccccgccaacaccgaggagacccugcccuuccaccugcagcuggagaagcagguggugcacgccgagauccagaaccugggccacuggauggacggcaccuucaacaucaagaccgccuuccacugcuacggcgagugcaagaaguacgccuaccccuggcagaccgccaagugcuucuucgagaaggacuaccaguacgagaccagcuggggcugcaacccccccgacugccccggcgugggcaccggcugcaccgccugcggcguguaccuggacaagcugagaagcgugggcaaggccuacaagaucgugagccugaaguacaccagaaaggugugcauccagcugggcaccgagcagaccugcaagcacaucgacgugaacgacugccuggugagccccagcgugaaggugugcaugaucggcaccgugagcaagcugcagcccggcgacacccugcuguuccugggcccccuggagcagggcggcaucauccugaagcaguggugcaccaccagcugcguguucggcgaccccggcgacaucaugagcaccaccagcggcaugagaugccccgagcacaccggcagcuucagaaagaucugcggcuucgccaccacccccaccugcgaguaccagggcaacaccaucagcggcuucaagagaaugauggccaccagagacagcuuccagagcuucaacgugaccgagccccacaucaccagcaacagacuggaguggaucgaccccgacagcagcaucaaggaccacaucaacguggugcugaacagagacgugagcuuccaggaccugagcgacaaccccuacaagguggaccugcacacccagagcaucgacggcgccuggggcagcggcgugggcuucacccuggugugcaucgugggccugaccgagugcgccaacuucaucaccagcaucaaggccugcgacauggccaugugcuacggcgccaccgugaccaaccugcugagaggcagcaacaccgugaagguggugggcaagggcggccacagcggcagccuguucaagugcugccacgacaccgacugcaccgaggagggccuggccgccagccccccccaccuggacagagugaccggcuacaaccagaucgacagcgacaaggugugcgacgacggcgccccccugugcagcgugaagugcugguucaccaagagcggcgaguggcugcugggcauccugaacggcaacuggauggugguggccgugcugguggugauccugauccugagcauccugcuguucagcuucuucugccccaucagaagcaagaagagcaagcccaacuga

SEQ ID NO: 8607 - RNA, 3399 nt, Artificial Sequence
  derived and/or modified CDS sequence (opt4) from THAIV(Thai749)__L08756.1__GP
auguggggccugcuggugaucgccgugcuggugggccccggcuucgccaucaagaacguguacgacaugaagaucgagugcccccacagcgugaacuucggcgagaccagcgugaccggccagguggagcugcccgcccugcccaucaccgaggccgagcagcuggugcccgagagcagcugcaacauggacaaccaccagagccuggccaccaucaacacccugaccaaggugagcuggagaaagaaggccgaccaggugagcgccagccagaacagcuucgaggugaucgaggccgagaccagcuucaagggccugugcaugcugaagcacagaaugaucgaggagagcuucaagaacagaagaagcgugaucugcuacgaccugagcugcaacaccaccuucugcaagcccaccguguacaugguggugcccgugcacgccugcaacaugaugaagagcugccuggugggccugggccccuacagagugcaggugguguacgagagaaccuacugcaccgugggcauccugaccgagggcaagugcuucauccccgacaagaccauccugagcagcaucaagagaggcauguucguggugaccagcgugcaggugcugugcuucuucaucgugcagaagggccacagcuacaagaucauggacgaggugaagaagagcaugaugaacaagugcaacgacaccgagaacaaggugcagggcuacuacaucugcauccugggcggcaacagcgcccccguguacgugcccagccuggacgacuucagaagcauggagaucuucagcaacaugcugagaagccccuucggcgaggaccacgaccugcccggcgaggaguucagcaccuaccagaucgccggccccaccgaggccaaggugccccacaccgccagcagcaagaaccuggcccugaucgccuacagcggcaaccccagcuacagcagccugagccugaucaccagcagccaggacggcagauacguguucagccccggccuguuccccaaccugaaccagacccagugcgagaagaacgcccugcccaugguguggagaggcaugaucgaccugagcggcuacuacgaggccauccaccccugcaacaucuucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggacauggacaucgugguguacugcaacggccagaagaagaccauccugaccaagacccugaucaucggccagugcaucuacaccaucaccagccuguucagccugcugcccggcguggcccacagcaucgccaucgagcugugcgugcccggcuuccacggcugggccaccgccgcccugcugaucaccuucugcuucggcuggauccugauccccaccaucacccuggccgugcugguggugcugaaguucaucgccaacauccugcacaccaacagccaggagaacagauucaagcugauccugaagaaggugaaggaggaguucgagaagaccaagggcagcauggugugcgaggugugcaaguacgagugcgagaccagcaaggagcugaaggcccacaaccugagcugcccccagagcaagugccccuacugcuucacccacugcgagcccaccgaggccaccuucaaggcccacuacaaggugugccaggccacccacagauucagagaggaccugaagaagaccgugaccccccagaccgugggccccggcugcuacagaacccugaaccuguucagauacaagagcagaugcuacauccugaccauguggcuguuccugcugagcaucgagagcaucaugugggccgccagcgccgccgagaucccccuggugccccuguggaccgacaacgcccacggcaucggcagcgugcccaugcacaccgaccuggagcuggacuucagccugcccagcagcagcaaguacaccuacaagagaaagcugaccaaccccgugaacaccgagcagggcgugcagcugcacaucgagaucgaggagcagggcaucggcgccgacgugcaccaccugggccacugguucgacgccagacugaaccugaagaccagcuuccacugcuacggcgccugcagcaaguaccaguaccccuggcacaccgccaagugccacuucgagaaggacuacgaguacgagaacagcugggccugcaaccccgccgacugccccggcgugggcaccggcugcaccgccugcggccuguaccuggaccagaugaagcccaucggcaccgccuacaagcugguggccaucagauacagcagaaaggccugcgugcaguucggcgaggagcaccugugcaagaccaucgacaugaacgacugcuucgugaccagacacgugaagaucugcaucaucggcaccgugagcaaguucauccagggcgacacccugcuguuccugggcccccuggagggcggcggccugaucuucaagcacuggugcaccagcaccugccaguucggcgaccccggcgacaucaugagccccaaggacaagcccuuccugugccccgaguuccccggccaguucagaaagaagugcaacuucgccaccacccccgugugcgaguacgacggcaaccagaucagcggcuacaagaagaugaaggccaccaucgacagcuuccagagcuucaacaccagcagcauccacuucaccgacgagagacugauggaggaccccgacggcaugcugagagaccacaucaacaucguggugaccaaggacaucgacuucgagaaccuggccgagaaccugugcggcaucggccugcaggugagcgccaucaagggcgccuggggcagcggcgugggcuucacccugaccugccaggugagccugaccgagugccccaccuuccugaccagcaucaaggccugcgacauggccaucugcuacggcgccgagagcgugacccuggugagaggccagaacaccgugaagaucagcggcaagggcggccacagcggcagcagcuucaagugcugccacggcguggacugcagcagcaacggccugcaggccaaccccccccaccuggacagaguggccggcgugagcgagcugaccaacgagaagguguacgacgacggcgccccccagugcggcaucgccugcugguucaucaagagcggcgagugggugaagggcaucuucagcggcaacuggaucgugcugaucgugcugugcgugcugcugcugaucagccugauccugcugggcaucuucugccccgugagaaagcacaagaagagcuga

SEQ ID NO: 8608 - RNA, 3426 nt, Artificial Sequence
  derived and/or modified CDS sequence (opt4) from TULV(Moravia/5302v/95)__NC_005228.1__GP
auguucugccugugccugagccugcugggccugcugcugugcuggcccgccgccaccagaaaccugcuggagcugaagguggagugcccccacaccaucggccugggccagggcaucgugaucggcagcgccgagcugccccccgugccccuggccaagguggagagccugaagcuggagagcagcugcaacuucgaccugcacaccagcaccgccgcccagcaggccuucaccaaguggagcugggagaagaaggccgacaccgccgagaacgccaaggccgccagcaccaccuuccagagcagcagcaaggaggugcagcugagaggccugugcgugauccccacccuggugcuggagaccgccagcagaaccagaaagaccgugaccugcuucgaccugagcugcaaccagaccgugugccagcccaccguguaccugauggcccccauccagaccugcgugaccaccaagagcugccugcugggccugggcgaccagagaauccaggugguguacgagaagaccuacugcgugagcggccagcugaucgagggcaacugcuucaacccccugcacaccaucgccaucagccagcccacccacaccuacgacaucaugacccuggccgugcacugcuucuucaucagcaagaagggcggcaccgacgacacccugaagaucgagaagcaguucgagacccugguggagaagaccggcugcaccgagaacgcccugaagggcuacuacgccugcauccugggcaccagcagcgaggugguguacgugcccgccauggacgacuacagaagcagcgagauccugagcagaaugaccaccgccccccacggcgaggaccacgacaucgaccccaacgccaucagcagccugagaaucgugggccagcugaccggcaaggcccccagcaccgagagcagcgacaccgugcagggcaucgccuucgccggcaccccccuguacaccagcaccagcauccuggugagaaaggaggaccccaucuaccuguggagccccggcaucauccccgagggcaaccacagccagugcgacaagaagacccugccccugaccuggaccggcuucaucacccugcccggcgagaucgagaagaccacccagugcaccguguucugcacccugagcggccccggcgccgacugcgaggccuacagcgacaccggcaucuucaacaucagcagccccaccugccuggugaacagagugcagagauucagaggcgccgagcagcaggugaaguucgugugccagagaguggaccuggacaucaccguguacugcaacggcgugaagaaggugauccugaccaagacccuggugaucggccagugcaucuacaccuucaccagcaucuucagccugaugcccggcguggcccacagccuggccguggagcugugcgugcccggccugcacggcugggccaccaucagccugcugaucaccuucugcuucggcuggcuggccaucccccugcugagcaugaucaucaucagauuccugcugaucuucaccuaccugugcagcaaguacagcaccgacagcaaguucaagcugaucaucgagaaggugaagcaggaguaccagaagaccaugggcagcauggugugcgaggugugccagcagggcugcgagaccgccaaggagcuggagagccacaagaagagcugcccccacggccagugccccuacugccugaaccccaccgaggccaccgagagcgcccugcaggcccacuucaaggugugcaagcugaccaccagauuccaggagaaccugaagaagagccugagcaccuacgagcccaagagaggccuguacagaacccugagcauguucagauacaagagcaagugcuacgugggccugguguggugcauccugcugaccauggagcugaucgugugggccgccagcgccgagaccaucaaccuggagcccggcuggaccgacaccgcccacggcagcggcaucaucccccugaagaccgaccuggagcuggacuucagccugcccagcagcgccaccuacaccuacagaagagagcugcagaaccccgccaacgagcaggagaagauccccuuccacuuccagauggagagacaggugauccacgccgagauccagcaccugggccacuggauggacggcaccuucaaccugaagaccgccuuccacugcuacggcagcugcaucaaguacgccuaccccuggcagaccgccaagugcuuccuggagaaggacuucgaguucgagaccggcuggggcugcaacccccccgacugccccggcgugggcaccggcugcaccgccugcggcguguaccuggacaagcugagaagcgugggcaagguguacaagauccugagccugaaguacaccagaaaggugugcauccagcugggcaccgagcagaccugcaagaccaucgacagcaacgacugccuggugaccaccagcgugaaggugugcaugaucggcaccaucagcaaguuccagcccggcgacacccugcuguuccugggcccccuggaggagggcggcaugaucuucaagcaguggugcaccaccaccugccaguucggcgaccccggcgacaucaugagcaccccccugggcaugaagugccccgagcacgccggcagcuucagaaagaagugcagcuucgccacccugcccagcugccaguacgacggcaacaccgugagcggcuaccagagaaugaucgccaccaaggacagcuuccagagcuucaacaucaccgagccccacaucaccaccaacagccuggaguggguggaccccgacagcagccugaaggaccacgugaaccugaucgugaacagagaccugagcuuccaggaccuggccgagaaccccugccagguggaccugagcgugagcagcaucgacggcgccuggggcagcggcgugggcuucaaccuggugugcagcgugagccugaccgagugcgccagcuuccugaccagcaucaaggccugcgacagcgccaugugcuacggcagcagcaccgccaaccuggugagaggccagaacaccgugcacguggugggcaagggcggccacagcggcagcaaguucaugugcugccacgacaagaagugcagcgccaccggccugguggccgccgccccccaccuggacagagugaccggcuacaaccagaucgacaccaacaagguguucgacgacggcgccccccagugcggcgugcacugcugguucaagaagagcggcgaguggcugcugggcauccugagcggcaacuggauggugguggccgugcugaucgcccuguucaucuucagccugcugcuguucagccugugcugccccagaagacagaacuacaagaagaacaaguga

SEQ ID NO: 8609 - RNA, 5055 nt, Artificial Sequence
  derived and/or modified CDS sequence (opt4) from CCHFV(10200)__U39455.2__GP
augcacaucagccugauguacgccauccugugccugcagcugugcggccugggcgagacccacggcagccacaacgagaccagacacaacaagaccgacaccaugaccacccacggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcuucagaagacugcugagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcuga

SEQ ID NO: 8610 - RNA, 5055 nt, Artificial Sequence
  derived and/or modified CDS sequence (opt4) from CCHFV(IbAr10200)__AF467768.2__GP
augcacaucagccugauguacgccauccugugccugcagcugugcggccugggcgagacccacggcagccacaacgagaccagacacaacaagaccgacaccaugaccacccccggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaagggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacaggugggcgaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggcuga

SEQ ID NO: 8611 - RNA, 5067 nt, Artificial Sequence
  derived and/or modified CDS sequence (opt4) from CCHFV(Turkey-Kelkit06)__GQ337054.1__GP
augcccaccaacaucaugcacaccccccuggugugcuucauccuguaccugcagcugcugugccugggcggcgcccacggccagcugaacgccaccgagcacaacggcaccaacaacaccaccgcccccggcgccagccagagccccaagccccccaugagcaccacccccccccacgcccccgagagcagcaccaucaagcccaccacccccaucagcgaggccgagggcagcggcgagaccaccagcccccccaacaccacccagggccugagcagccccgagaccaccagcgagagacccgccaccaccagcaucagcaccagcagcaccgacagcaccaaccccaccacccagaugaccgacaacacccccacccccaccgugagcaccagccccagcagcagccccagcacccccagcaccccccagggcauccaccaccccgccagaagccugcugagcgugagcagccccaagaccgugaccacccccacccccaccagccccggcgagaugagcagcgagaccagcagccagcacagcgccaugagcagaauccccaccccccacaccgccaccagagugagcaccgagaucaccaaccacagaacccccagacagagcgagagcagcgcccagcagaccacccccagccccaugaccagccccgcccagagcauccugcugaugagcgccgcccccaccgccgugcaggacauccaccccagccccaccaacagaagcaagagaaaccuggagaccgagaucauccugacccugagccagggccugaagaaguacuacggcaagauccugaagcugcugcaccugacccuggagcaggacaccgagggccugcuggaguggugcaagggcaaccugggcagcaacugcgacgacgacuucuuccagaagagaaucgaggaguucuucaugaccggcgagugcuacuucaacgaggugcugcaguucaagacccugagcacccugagccccaccgagcccagccacgccagacugcccaccgccgagcccuucaagagcuacuucgccaagggcuuccugagcaucgacagcggcuacuucagcgccaagugcuaccccagaagcagcgccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcuucagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgagagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggugcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggagccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggcccugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcggcaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggcuga

SEQ ID NO: 8612 - RNA, 5103 nt, Artificial Sequence
  derived and/or modified CDS sequence (opt4) from CCHFV(UCCR4416)__KY484026.1__GP
auguuccugcacuucaaguucaugcugcugaccaacuucuucuucugccagcugcuguggggcggcggcggcguggccagcggcggcagaaccaacaccagcagcacccagaccacccugaucagcagcaacacccugaacagcaccaugagcgugcuggagagcagcaucggcaccgccaccgagaccgugcccagcaccaccaccaacacccccgacacccaggugaccaccgacagcggcagcggcgagagcagcaccgacccccagaccaccagcaaggaggugcccagcaccagcguggccaccaucaagacccaggagagcgagacccacagagcccagaaccccagcaccaccgccggcagcggcgccagcacccccagcaacaccaccagcaacaagcccgacgugaacagccugaccagccccauccuggaggccaagagcagccccagccccagcaagaccagcaugccccagaccgcccaccaccugagcagaagccugcugagcgccgccaccaccgagaccaaccaggccgccagcgugaugaccaccaccagagagaccaccaccaugagcagccccaccaccgugaagaacagcgugaccgccauccccacccagggcaucaccaccagcaacaccagcaagcagaccgacaccaucacccuggagaucagccccaagauccagaccacccagagccagcagaccgccacccccgccaucgcccccgccaccaccgccaucgccuucaucagccccaccaacagaagcaagagagagagcaaggugcagaucauccugaccuucagccagggccugaagaaguacuacagcaagauccugaagcugcugcaccugacccaggaggaggacagcgagggccugcuggaguggugcaccagagugcuggagcaggccugcaacgacgacuacuucaacgagagaaucgaggaguucuucaucaccggcaagggcuacuucaacgacgugcugcaguucagacuguacgacacccugagcaccaccgagagcacccagaacaccagccccaccgccaagcccuucagaagcuacuacgccaagggcagccugaccuucgacagcggcuacuucagcgccaagugcuaccccagagccagcaacagcggccugcagcugaucaacgugacccagcacagcgugaagaucgccaacacccccggccccaagaucagcaaccccaagaccaucaacugcaucaaccugaaggugagcaccgacaaggaccacagcaagcuggagaucaacgugcugcugccccagguggccgugaaccugagcaacugccacgugcugaucgagagccacgugugcgacuacagccuggacaccgacggcaccaucaagcugcccaagaucacccacaacggcgccuucauccccggcaccuacaagaucgugaucgacaagaagaacaagcugaacgacagaugcgcccuguucaccaacugcgugaucaagggcagagaggugagaagaggccagagcgcccugagacaguacagaaccgagaucagaaucggccagaccuucaccggcagcagaagacugcuggccgagggcggcagcaacgacugcgugagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugagaaccuacaagcugugcgagaacagcgccaccgagaagagcugcgagaucgacagcgugcccgugaagugcaagcagggcuucugccugaagaucacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacaucccccugcugggcagaaccgccaucuacgugugcagaaugagcaaccaccccaagaccaccauggccuuccuguucugguucagcuucggcuacgugaucaccugcguggugugcaaggugcuguucuaccugcugaucgugaucggcacccugggcaagagacugaagcaguacagagagcugaagccccagaccugcaucgugugcgagagcauccccgugaacgccaucgacgccgagaugcacgaccugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaaagcugcugcaggugagcgagagcaccggcguggcccugaagagaagcugcuggaugaucacccugcugauccugcugaccgugagcaugagccccgugcagagcgcccccgugggccacaagagagccguggagguguaccagaugagagagagcuacaccggcaucugccuguucgugcugggcagcgugcuguucgccgugagcuggcuggugaaggcccugaucgacagcaucggcaacagcuucuuccccggccugagcaucugcaagaccugcagcaucggcagcaucaacggcuucgagaucgagagccacaagugcuacugcagccuguucugcugccccuacugcagagccugcagcagcgacaagaucacccacagaaugcaccugaacgugugcaagaagagaaaggugggcagcaacgugaugcuggccgugugcaagagaaugugcuucaaggccaccaucgaggccagcaacagagccaccuucaucagaaacaucaucaacagcaccuucgugaucugcauccugauccuggugaucugcguggugagcaccagcgccguggacauggagaaccugcccgccggcaucugggagaaggaggaggaccugaccaacuucugccaccaggagugccaggugaccgagaccgagugccugugccccuacgaggcccugaugcugagaaagccccuguuccuggacagaaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacaagggcaacaagauccuggugagcggcagaagcgagagcaucaugaagcuggaggagagaaccggcaucagcuggugccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacaugcuggugaaguggaagguggaguacaucaagaccgaggccaucaucugcguggagcugaccagccaggagagacagugcagccugaucgaggccggcaccagauucaaccugggccccgugaccaucacccugagcgagcccagaaacgugcagcagagacugccccccgagaucaucacccugcaccccaagaucgaggagggcuucuucgaccugaugcacgugcagaaggugaugagcgccagcaccgugugcaagcugcagagcugcacccacggcgugcccggcgaccugcagguguaccacgugggcaaccugcugaagggcgacaaggugaacggccacagcauccacaagaucgagagccaccugaacaccagcuggaugagcugggacggcugcgaccuggacuacuucugcaacaugggcgacuggcccagcugcaccuacaccggcgugacccagcacaaccacgccgccuucaucaacaugcugaacaucgagaccgacuacaccaagaccuuccacuuccacagcaagagagugaccgcccacggcgacaccccccagcuggaccugaaggccagacccgccuacggcgccggcgagaucaccgugcugguggagguggccgaccuggagcugcacaccaagaagaucgaggugagcggccugaaguucgccagccugagcugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagagcggcgccgacagcaccuucaaggccuucagcagcaugcccaagaacagccugugcuucuacaucguggagagagacuacugcagcagcugcaccgacgacgacacccagaagugcguggacaucaagcuggagcacccccagagcauccugaucgagcacaagggcaccaucaucggcaagcagaacgacaccugccccaccaagaccagcugcuggcuggagagcaucaagagcuucuucuacggccugaagaacaugcugagcggcaucuucggcaacguguuccugggcaugcugcuguuccuggcccccuucauccugcugauccuguucuucuucuucggcuggagacugcuguucugccugaagugcugcagaagaaccagaaagcugcugaaguacaagcaccugagagacgaggaggagagcggcuacaagaagaucaucgagagacugaacgacaagaagggcaagagcagacuguucgacggcgagagacuggccgacagaaagaucgccgagcuguucagcaccaagacccacaucggcuga

SEQ ID NO: 8613 - RNA, 5103 nt, Artificial Sequence
  derived and/or modified CDS sequence (opt4) from CCHFV(ArD15786)__DQ211627.1__GP
auguuccugcacuucaaguucgugcugcugaccaacuucuucuucugccagcugcuguggggcggcggcggcgugaccagcggcggcggcaccaacaccagcagcacccaggccauccugaucagcagcaacacccccaacagcaccaugagcgugcuggagagcagcaccggcaccgccgccgagaccgugcccagcaccaccaucaacacccccgacacccaggugaccaccgacagcggcagcggcgagagcagcaccgacccccagaccaccaacggcgaggugcccagcaccagcaucgccaccaucaagacccaggagagcgagaccagaagaacccagaaccugagcaccaccgccggcagcggcgccagcacccccggcaacaccaccagcaacaagcccgacgugaaccugcugaccagccccaucagcgaggccaagagcagccccagccccagcaagaccagcaccccccagaccgcccaccaccugagcagaagccugcugagcgccgccaccaccgagaccagccaggccgccagcgugaugaccaccaccagagagaccaccaccaugagcagccccaccaccgugaagaacagcgccaccgccacccccacccagggcaucaccaccagcaacaccagcaagcagaccgacaccaccacccuggagaucccccccaagauccagaccacccagagccagcagaccgccacccccgccaucacccccgccaccaccgccaucgccuucaucagccccaccaacagaagcaagagagagagcaaggugcagaucauccugaccuucagccagggccugaagaaguacuacagcaagauccugaagcugcugcaccugacccaggaggaggacagcgagggccugcuggaguggugcaccagagugcuggagcaggccugcgacgacgacuacuucaacgagagaaucgaggaguucuucaucaccggcaagggcuacuucaacgacgugcugcaguucagacuguacgacaccuucagcaccaccgagagcacccagaacaccagccccaccgccaagcccuucagaagcuacuacgccaagggcagccugaccuucgacagcggcuacuucagcgccaagugcuaccccagagccagcaacagcggccugcagcugaucaacgugacccagcacagcgugaagaucgccaacacccccggccccaagaucagcaaccccaagaccaucaacugcaucaaccugaaggugagcaccgacaaggaccacagcaagcuggagaucaacgugcugcugccccagguggccgugaaccugagcaacugccacgugcugaucgagagccacgugugcgacuacagccugaacaccgacggcaccaucaagcugcccaagaucgcccacaacggcgccuucauccccggcaccuacaagaucgugaucgacaagaagaacaagcugaacgacagaugcgcccuguucaccaacugcgugaucaagggcagagaggugagaagaggccagagcgcccugagacaguacagaaccgagaucagaaucggccagaccuucaccggcagcagaagacugcuggccgagggcggcagcaacgacugcgugagcagaacccagcuggugaagaccgaggugaccgagauccacgaggacagcuacggcggccccggcgagaagaucaccaucugcaacggcagcaccaucguggaccagagacugggcagcgagcugggcugcuacaccaucaacagagugagaaccuacaagcugugcgagaacagcgccaccgagaagagcugcgagaucgacagcgugcccgugaagugcaagcagggcuucugccugaagaucacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacaucccccugcugggccagaccgccaucuacgugugcagaaugagcaaccaccccaagaccaccauggccuuccuguucugguucagcuucggcuacgugaucaccugcguggugugcaaggugcuguucuaccugcugaucgugaucggcacccugggcaagagacugaagcaguacagagagcugaagccccagaccugcaucgugugcgagagcauccccgugaacgccaucgacgccgagaugcacgaccugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaaagcugcugcaggugagcgagagcaccggcguggcccugaagagaagcugcuggaucaucacccugcugauccugcugaccgugagcaugagccccgugcagagcgcccccgugggccacaagagagccguggagguguaccagaucagagagagcuacaccggcaucugccuguucgugcugggcggcgugcuguucgccgugagcuggcuggugaaggcccugaucgacagcaucggcaacagcuucuuccccggccugagcaucugcaagaccugcagcaucggcagcaucaacggcuucgagaucgagagccacaagugcuacugcagccugcugugcugccccuacugcagagccugcagcagcgacaagaucacccacagaaugcaccugaacgugugcaagaagagaaaggugggcagcaacgugaugcuggccgugugcaagagaaugugcuucaaggccaccaucgaggccaacaacagagccaccuucaucagaaacaucaucaacagcaccuucgugaucugcauccugauccuggugaucugcguggugagcaccagcgccguggacauggagaaccugcccgccggcaucugggagaaggaggaggaccugaccaacuucugccaccaggagugccaggugaccgagaccgagugccugugccccuacgaggcccugaugcugagaaagccccugagccuggacagcaucgccaagggcaugaagagccugcugaacagcaccagccuggagaccagccugagcaucgaggcccccuggggcgccaucaacgugcagagcaccuucaagcccaccaucagcgccgccaacaucgcccugagcuggagcagcguggagcacaagggcaacaagauccuggugagcggcagaagcgagagcaucaugaagcuggaggagagaaccggcaucagcuggugccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacaugcuggugaaguggaagguggaguacaucaagaccgaggccaucaucugcguggagcugaccagccaggagagacagugcagccugaucgaggccggcaccagauucaaccugggccccgugaccaucacccugagcgagcccagaaacgugcagcagagacugccccccgagaucaucacccugcaccccaagaucgaggagggcuucuucgaccugaugcacgugcagaaggugaugagcgccagcaccgugugcaagcugcagagcugcacccacggcgugcccggcgaccugcagguguaccacgugggcaaccugcugaagggcgacaaggugaacggccacagcauccacaagaucgagagccaccugaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagagcggcgccgacagcaccuucaaggccuucagcagcaugcccaagaacagccugugcuucuacaucguggagagagacuacugcagcagcugcaccgacgacgacacccagaagugcguggacaucaagcuggagcacccccagagcauccugaucgagcacaagggcaccaucaucggcaagcagaacgacaccugccccaccaagaccagcugcuggcuggagagcaucaagagcuucuucuacggccugaagaacaugcugagcggcaucuucggcaacaucuuccugggcaugcugcuguuccuggcccccuucgugcugcugauccuguucuucuucuucggcuggagacugcuguucugccugaagugcugcagaagaaccagaaagcugcugaaguacaagcaccugagagacgaggaggagagcggcuacaagaagaucaucgagagacugaacgacaagaagggcaagagcagacuguucgacggcgagagacuggccgacagaaagaucgccgagcuguucagcaccaagacccacgugggcuga

SEQ ID NO: 8614 - RNA, 5100 nt, Artificial Sequence
  derived and/or modified CDS sequence (opt4) from CCHFV(UCCR4432)__KY484047.1__GP
auguucugccugagacuggugcugcugaucaaccuggcccugugccagcugcuggagggcaacgacggcgugaccagcgccgacgagaucaacagcaacaccacccagaccagccugggccugcccaccauccugaacagcaccacccccgcccccggccccagcaucgacgccaccauggaggccgugcccggcaccaccaacagcgugcuggagacccaggugaccauggacagcggcagcggcgagcugagcaccgaccccaccaccaccagagaggccaccacccccaucaccgccgccaccgugagcgcccaggagaccaagacccacaugacccagaaccccggcaccaccguggaccccgacaccaccaccagcaacaccaccaccagcaucgagcccaucaccaccccccccaccagccccaccccccaggccacccccacccccagcuacagcgagacccccacccugcccaacacccaccaccugagcagaagccugcugagcgccgugggcaccgaggccggccagaccgcccccgccacccccaccgccgagguggcccuggcccccggcggcagcagcaccgccgagagcaacaccaucagcauccccgcccaggacaccaccaucagcggcgugagcaagcaggacaaccccaccaccaccggcaucagccccgaggcccagaccaugcagagccagcaggccguggcccccgugaccacccccgccaccgccaucagcgcccccaccagccccaccaacagaagcaagagagagagcaaggugcagaucauccugaccuucccccagggccugaagaaguacuacagcaagauccugaaguuccugcaccugacccaggaggaggacagcgagggccugcuggaguggugcaccagagugcugcagcaggugugcgacgacaccuacuucaacgagagaaucaaggaguucuucaucaccggcaagggcuacuucaacgacgugcugcaguucaagcugcacgacacccccgccaccaccgugcccgcccuggccgccagcagcaccgccaugcccuucagaagcuacuacgccaagggcagccugacccuggacagcggcuacuucagcgccaagugcuaccccagagccagcaacagcggcaugcagcugaucaacgugacccagcaccccaugaagaucgccaacacccccggccccaagaucagcaaccugaagaccaucaacugcaucaaccugaaggugagcaccgacaaggagcacagcgagcuggagaucaacgugcugaucccccagguggccgugaaccugagcaacugcuucgugagcaucaagagccacgugugcgacuacagccuggacaccgacggcgccaucagacugcccaagguggcccacaacggcguguucaugcccggcaccuacaagaucgugaucgacaagaagaacaagcugaacgacagaugcgcccugaucaccaacugcgugaucaagggcagagaggugagaaagggccagagcacccugagacaguacaagaccgagaucagaaucggccagaccaucgccggcagcagaagacugcuggccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcaucgugugcaaggugcuguucuaccugcugaucgugaucggcacccugagcaagaagcugaagcaguacagagagcugaagccccagaccugcaucgugugcgagagcacccccgugaacgccaucgacgccgagaugcacgagcugaacugcaacuacaacaucugccccuacugcgccagcagacugaccagcgacggccuggugagacacgugaaccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggccagggcaaggccguggagguguacagagugagagagagcuacaccagcaucugccuguucgugcugggcagcgugcuguucgccgugagcuggcugaucaagggccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaucacccacagaaugcaccugaacgugugcaagaagagaaaggccggcagcaacgugaugcuggccgugugcaagagaaugugcuucaaggccaccguggaggccagcaacaccgcccugcugaucagaggcaucaucaacagcaccuucgugaucugcgugcugauccuggugaucugcguggugagcaccagcgccguggacauggagaaccugcccgccggcaucugggagagagaggaggaccugaccaacuucugccaccaggagugccaggugaccgagaccgagugccugugccccuacgaggcccugauccugagaaagccccuguaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccaggagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacauccagcagagacugcccagcgagaucgugacccugcaccccaagaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcagcgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccaacgacgacacccagaagugcguggacaccaagcuggagcacccccagagcauccugaucgagcacaagggcaccaucaucggcaagcagaacgacaccugcagcaccaagaccagcugcuggcuggagagcgugaagagcuucuucuacggccugaagaacaugcugggcggcaucuucggcaacguguuccugggcaucuuccuguuccuggcccccuucgcccugcugaucuucuucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggcuga

SEQ ID NO: 8615 - RNA, 5100 nt, Artificial Sequence
  derived and/or modified CDS sequence (opt4) from CCHFV(Nakiwogo)__KX013484.1__GP
auguucugccugaagcuggugcugcugaucaaccugacccugugccagcugcuggagggcaacgacagagugaccagcgccgacggcaucaacagcaacaccacccagaccaaccugggcaucagcaccauccugaacagcaccacccccgcccccggccccagcaccgacaccaccauggagaccgugcccagcaccgccgacagcaugcuggagacccaggugaccaccgacagcggcagcggcgagcccagcaccgagcccaccaccaccggcgaggccaccagcagcaccaccgccgccaccgugagcaugcaggagaccaagaagcacaugacccagaacaccagaagcaccgccgaccccgacaccaccacccccaacagcaccaccagcguggagcccaccaccaucccccccaccagccccaucccccaggccacccccacccccggccacggcaaggcccccacccugcccaacacccaccaccugagcagaagccugcugagcgccgugagcaccgaggccggccagaccacccccgccaccagcaccaccgaggccgccagcgcccccagcagcagcagcaccgccgagaacaacaccgugagccagcccgcccaggacaccaccaccagcggcgugagcgagcaguacaaccccaccaccaccggcaucagccccaaggcccagaccaugcagggccagcaggccaucgugcccgugaccacccccgugaccaccaccuucacccccaccaaccccaccaacagaagcaagagagagagcaaggugcagaucauccugaccuucccccagggccugaagaaguacuacagcaagauccugaagcugcugcaccugacccaggaggaggacagcgagggccugcuggaguggugcaccagagugcugcagcaggugugcgacgacaccuacuucaacgagagaaucgaggaguucuucaucaccggcaagggcuacuucaacgacgugcugcaguucaagcugcacgacacccccaccaccaccgugagcgcccuggccgccagcagcaccgccaugcccuucagaagcuacuacgccaagggcagccugacccuggacagcggcuacuucagcgccaagugcuaccccagagccagcaacagcggcaugcagcugaucaacgugacccagcaccccaugaagaucgccaacacccccggccccaagaccagcaaccugaagaccaugaacugcaucaaccugaaggugagcaccgacaaggagcacagcgagcuggagaucaacgugcugaucccccagguggccgugaaccugagcaacugccuggugagcaucaagagccacgugugcgacuacagccuggacaccgacggcgccaucagacugcccaagguggccuacaacggcguguucaugcccggcaccuacaagaucgugaucgacaagaagaacagacugaacgacagaugcgcccugaucaccaacugcgugaucaagggcagagaggugagaaagggccagagcacccugagacaguacaagaccgagaucagaaucggccagacccugaugggcagcagaagacugcuggccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcguggugugcaaggugcuguucuaccugcugaucgugaucggcacccugggcaagaagcugaagcaguacagagagcugaagccccagaccugcaucgugugcgagagcauccccgugaacgugaucgacgccgagaugcacgagcugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggccaggagaaggccaucgagguguaccaggugagagagagcuacaccagcaugugccuguucgugcugggcagcgugcuguucgccgugagcuggcuggugaagggccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaucacccacagaaugcaccugaacaucugcaagagaagaaaggugggcagcaacgugaugcuggccgugugcaagagaaugugcuucaaggccaccguggaggccagcaacagcgcccugcugaucagaagcaucaucaacagcaccuucgugaucugcgugcugauccuggugaucugcguggugagcaccagcgccguggacauggagaaccugcccgccggcaucugggagagagaggaggaccugaccaacuucugccaccaggagugccaggugaccgagaccgagugccugugccccuacgaggcccugauccugagaaagccccuguaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacgugcagcagagacugcccagcgagaucgugacccugcaccccaagaucgaggagggcuucuucgaccugaugcacgugcagaaggugcuguucugcaagcacagccugcaggccaccagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucgugaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagcugggcgccgacagcaccuucaaggccuucagcagcaugcccaagaacagccugugcuucuacaucguggagagagacuacugcagcagcugcaccgacgacgacacccagaagugcgugaacaccaagcuggagcacccccagagcauccugaucgagcacaagggcaccaucaucggcaagcagaacgacaccugccccaccaagaccagcugcuggcuggagagcgugaagagcuucuucuacggccugaagaacaugcugggcggcaucuucggcaacguguuccugggcaucuuccuguuccuggcccccuucgcccugcugauccuguucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggcuga

SEQ ID NO: 8616 - RNA, 5100 nt, Artificial Sequence
  derived and/or modified CDS sequence (opt4) from CCHFV(UG3010)__AY900143.1__GP
auguucugccugagacuggugcugcugaucaaccuggcccugugccagcugcuggagggcaacgacggcgugaccagcgccgacgagaucaacagcaacaccacccagaccagccugggccugcccaccauccugaacagcaccacccccgcccccggccccagcaucgacgccaccauggaggccgugcccggcaccaccaacagcgugcuggagacccaggugaccauggacagcggcagcggcgagcugagcaccgaccccaccaccaccagagaggccaccacccccaucaccgccgccaccgugagcgcccaggagaccaagacccacaugacccagaaccccggcaccaccguggaccccgacaccaccaccagcaacaccaccaccagcaucgagcccaucaccaccccccccaccagccccaccccccaggccacccccacccccagcuacagcgagacccccacccugcccaacacccaccaccugagcagaagccugcugagcgccgugggcaccgaggccggccagaccgcccccgccacccccaccgccgagguggcccuggcccccggcggcagcagcaccgccgagagcaacaccaucagcauccccgcccaggacaccaccaucagcggcgugagcaagcaggacaaccccaccaccaccggcaucagccccgaggcccagaccaugcagagccagcaggccguggcccccgugaccacccccgccaccgccaucagcgcccccaccagccccaccaacagaagcaagagagagagcaaggugcagaucauccugaccuucccccagggccugaagaaguacuacagcaagauccugaaguuccugcaccugacccaggaggaggacagcgagggccugcuggaguggugcaccagagugcugcagcaggugugcgacgacaccuacuucaacgagagaaucaaggaguucuucaucaccggcaagggcuacuucaacgacgugcugcaguucaagcugcacgacacccccgccaccaccgugcccgcccuggccgccagcagcaccgccauccccuucagaagcuacuacgccaagggcagccugacccuggacagcggcuacuucagcgccaagugcuaccccagagccagcaacagcggcaugcagcugaucaacgugacccagcaccccaugaagaucgccaacacccccggccccaagaucagcaaccugaagaccaucaacugcaucaaccugaaggugagcaccgacaaggagcacagcgagcuggagaucaacgugcugaucccccagguggccgugaaccugagcaacugcuucgugagcaucaagagccacgugugcgacuacagccuggacaccgacggcgccaucagacugcccaagguggcccacaacggcguguucaugcccggcaccuacaagaucgugaucgacaagaagaacaagcugaacgacagaugcgcccugaucaccaacugcgugaucaagggcagagaggugagaaagggccagagcacccugagacaguacaagaccgagaucagaaucggccagaccaucgccggcagcagaagacugcuggccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcaucgugugcaaggugcuguucuaccugcugaucgugaucggcacccugagcaagaagcugaagcaguacagagagcugaagccccagaccugcaucgugugcgagagcacccccgugaacgccaucgacgccgagaugcacgagcugaacugcaacuacaacaucugccccuacugcgccagcagacugaccagcgacggccuggugagacacgugaaccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggccagggcaaggccguggagguguacagagugagagagagcuacaccagcaucugccuguucgugcugggcagcgugcuguucgccgugagcuggcugaucaagggccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaucacccacagaaugcaccugaacgugugcaagaagagaaaggccggcagcaacgugaugcuggccgugugcaagagaaugugcuucaaggccaccguggaggccagcaacaccgcccugcugaucagaggcaucaucaacagcaccuucgugaucugcgugcugauccuggugaucugcguggugagcaccagcgccguggacauggagaaccugcccgccggcaucugggagagagaggaggaccugaccaacuucugccaccaggagugccaggugaccgagaccgagugccugugccccuacgaggcccugauccugagaaagccccuguaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccaggagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacauccagcagagacugcccagcgagaucgugacccugcaccccaagaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcagcgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccaacgacgacacccagaagugcguggacaccaagcuggagcacccccagagcauccugaucgagcacaagggcaccaucaucggcaagcagaacgacaccugcagcaccaagaccagcugcuggcuggagagcgugaagagcuucuucuacggccugaagaacaugcugggcggcaucuucggcaacguguuccugggcaucuuccuguuccuggcccccuucgcccugcugaucuucuucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggcuga

SEQ ID NO: 8617 - RNA, 5100 nt, Artificial Sequence
  derived and/or modified CDS sequence (opt4) from CCHFV(Semunya)__DQ094832.1__GP
auguucugccugaagcuggugcugcugaucaaccuggcccugugccagcugcuggagggcaacgacagagugaccagcgccgacggcaucaacagcaacaccacccagaccaaccugggcaucagcaccauccugaacagcaccacccccgcccccggccccagcaccgacaccaccauggagaccgugcccagcaccgccgacagcaugcuggagacccaggugaccaccgacagcggcagcggcgagcccagcaccgagcccaccaccaccggcgaggccaccagcagcaccaccgccgccaccgugagcaugcaggagaccaagacccacaugacccagaacaccagaagcaccgccgaccccgacaccaccacccccaacaccaccaccagcguggagcccaccaccaucccccccaccagccccauccugcaggccacccccacccccggccacggcaaggcccccacccugcccaacacccaccaccugagcagaagccugcugagcgccgugagcaccgaggccggccagaccacccccgccaccagcaccaccgaggccgccagcgcccccagcagcagcagcaccgccgagaacaacaccauguuccagcccgcccaggacaccaccaccagcggcgugagcgagcaguacaaccccaccaccaccggcaucagccccaaggcccagaccaugcaggcccagcaggccaucgugcccgugaccacccccgugaccaccaccuucacccccaucaaccccaccaacagaagcaagagagagagcaaggugcagaucauccugaccuucccccagggccugaagaaguacuacagcaagauccugaagcugcugcaccugacccaggaggaggacagcgagggccugcuggaguggugcaccagagugcugcagcaggugugcgacgacaccuacuucaacgagagaaucgaggaguucuucaucaccggcaagggcuacuucaacgacgugcugcaguucaagcugcacgacacccccaccaccaccgugcccgcccuggccgccagcagcaccgccaugcccuucagaagcuacuacgccaagggcagccugacccuggacagcggcuacuucagcgccaagugcuaccccagagccagcaacagcggcaugcagcugaucaacgugacccagcaccccaugaagaucgccaacacccccggccccaagaccagcaaccugaagaccaugaacugcaucaaccugaaggugagcaccgacaaggagcacagcgagcuggagaucaacgugcugaucccccagguggccgugaaccugagcaacugccuggugagcaucaagagccacgugugcgacuacagccuggacaccgacggcgccaucagacugcccaagguggccuacaacggcguguucaugcccggcaccuacaagaucgugaucgacaagaagaacagacugaacgacagaugcgcccugaucaccaacugcgugaucaagggcagagaggugagaaagggccagagcacccugagacaguacaagaccgagaucagaaucggccagacccugaugggcagcagaagacugcuggccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcguggugugcaaggugcuguucuaccugcugaucgugaucggcacccugggcaagaagcugaagcaguacagagagcugaagccccagaccugcaucgugugcgagagcauccccgugaacgccaucgacgccgagaugcacgagcugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggccaggagaaggccaucgagguguaccaggugagagagagcuacaccagcaucugccuguucgugcugggcagcgugcuguucgccgugagcuggcuggugaagggccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaucacccacagaaugcaccugaacaucugcaagagaagaaaggugggcagcaacgugaugcuggccgugugcaagagaaugugcuucaaggccaccguggaggccagcaacagcgcccugcugaucagaagcaucaucaacagcaccuucgugaucugcgugcugauccuggugaucugcguggugagcaccagcgccguggacauggagaaccugcccgccggcaucugggagagagaggaggaccugaccaacuucugccaccaggagugccaggugaccgagaccgagugccugugccccuacgaggcccugauccugagaaagccccuguuccuggacagcaucgccaagggcaagaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacgugcagcagagacugcccagcgagaucgugacccugcaccccaagaucgaggagggcuucuucgaccugaugcacgugcagaaggugcuguucugcaaguacagccugcaggccaccagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucgugaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccgacgacgacacccagaagugcgugaacaucaagcuggagcacccccagagcauccugaucgagcacaagggcaccaucaucggcaagcagaacgacaccugccccaccaagaccagcugcuggcuggagagcgugaagagcuucuucuacggccugaagaacaugcugggcggcaucuucggcaacguguuccugggcaucuuccuguuccuggcccccuucgcccugcugauccuguucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccaagcuguucagcaccaagacccacaucggcuga

SEQ ID NO: 8618 - RNA, 5094 nt, Artificial Sequence
  derived and/or modified CDS sequence (opt4) from CCHFV(79121)__AB069673.1__GP
augcuguuccacuucaaguucaugcugcugaucaacuucauccugugccaccugcuguggggcggcggcggcgugaccggcggcguggagaccaacagcagcagcacccaggccauccagaccccccccgugaccagcaacagcaccacccccggccccagcaccgacaccgccaccgagaccgccagcagcaugaccaccagcacccccgacacccaggugaccaccgacaacggcagcggcgagcccagcaccgacccccugaccaccaacgaggccacccccccccugagcgugaccaccgcccagaccaccgagaccaagaagcacaccacccuggaccccagcaccagcaccaaccccgacgccaccacccccagcaucaccauccugagcgccagcaacaccagccugcccaucagcagcgugcacgccagccccagccccagcagcagcgaggagcccaccccccagaacgcccaccaccugagcagaagccugcugagcgccgugagcaccgagaccggccagaucgccagcgccgccaccgccgccaaggagaucaccaccaagaacagcccccccaccgccggcaacgacaccauggugaccagcgcccccaacggcaacaucagaaacacccccgagcaggccaaccccaccgcccccgaggccagccccaagauccagaccacccagaaccagcagaccgugacccccgaggccacccccaucaccaccaucaccgcccugaccgaccugaccaacagaagcaagagagacagcaaggugcagaagauccugaccuucagccagggccugaagaaguacuacagcaagauccugaagcugcugcagcugacccaggaggaggacagcgagggccugcuggaguggugcaccagagugcuggagcaggccugcgacgacgacuacuucaacaagagaaucgaggaguucuucaucaccggcaagggcuacuucaacgacgugcugcaguucagacugcacgacgcccugagcaacaccgagcccgcccagaccaccagccccaccgccgugcccuucaagagcuacuacgccaagggcagccugaccuucgacagcggcuacuucagcgccagaugcuaccccagagccagcaacagcggccugcagcugaucaacgugacccagcaccccgugaagaucgccaacacccccggccccaagcugagcaaccugaagaccaucaacugcaucaaccugaaggugagcaccgacaaggagcacagcgagcuggaggugaacgugcugcugccccagguggccgugaaccugagcaacugccacgugagcaucaagagccacgugugcgacuacagccuggacaccgacggcgccaucaagcugcccagaguggcccacaacggcguguucauccccggcaccuacaagaucgugaucgacaagaagaacaaccugaacgacagaugcacccugaucaccaacugcgugaucaagggcagagaggugagaaagggccagagcgcccugagacaguacaagaccgagaucagaaucggccagaccuucaccggcagcagaagacugcuggccgagggcggcagcagcgacugcaucagcagaacccagcuggugaagaccgagguggccgagauccacgaggacagcuacggcggccccggcgagaagaucaccaucugcaacggcagcaccaucguggaccagggccugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcaaggagagagccaucgagaccuaccaggccagagagaccuacaccggcaucugccuguucgugcugggcagcgugcuguucgccgugagcuggcugaccaaggcccugaucgacggcaucggcaacagcuucagccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacagcaccgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagaucuaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaaccuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggcuga

SEQ ID NO: 8619 - RNA, 5094 nt, Artificial Sequence
  derived and/or modified CDS sequence (opt4) from CCHFV(7001)__AB069670.1__GP
augcuguuccacuucaaguucaugcugcugaucaacuucauccugugccaccugcuguggggcggcggcggcgugaccggcggcguggagaccaacagcagcagcacccaggccauccagaccccccccgugaccagcaacagcaccacccccggccccagcaccgacaccgccaccgagaccgccagcagcaugaccaccagcacccccgacacccaggugaccaccgacaacggcagcggcgagcccagcaccgacccccugaccaccaacgaggccacccccccccugagcgugaccaccgcccagaccaccgagaccaagaagcacaccacccuggaccccagcaccagcaccaaccccgacgccaccacccccagcaucaccauccugagcgccagcaacaccagccugcccaucagcagcgugcacgccagccccagccccagcagcagcgaggagcccaccccccagaacgcccaccaccugagcagaagccugcugagcgccgugagcaccgagaccggccagaucgccagcgccgccaccgccgccaaggagaucaccaccaagaacagcccccccaccgccggcaacgacaccauggugaccagcgcccccaacggcaacaucagaaacacccccgagcaggccaaccccaccgcccccgaggccagccccaagauccagaccacccagaaccagcagaccgugacccccgaggccacccccaucaccaccaucaccgcccugaccgaccugaccaacagaagcaagagagacagcaaggugcagaucauccugaccuucagccagggccugaagaaguacuacagcaagauccugaagcugcugcagcugacccaggaggaggacagcgagggccugcuggaguggugcaccagagugcuggagcaggccugcgacgacgacuacuucaacaagagaaucgaggaguucuucaucaccggcaagggcuacuucaacgacgugcugcaguucagacugcacgacgcccugagcaacaccgagcccgcccagaccaccagccccaccgccgugcccuucaagagcuacuacgccaagggcagccugaccuucgacagcggcuacuucagcgccagaugcuaccccagagccagcaacagcggccugcagcugaucaacgugacccagcaccccgugaagaucgccaacacccccggccccaagcugagcaaccugaagaccaucaacugcaucaaccugaaggugagcaccgacaaggagcacagcgagcuggaggugaacgugcugcugccccagguggccgugaaccugagcaacugccacgugagcaucaagagccacgugugcgacuacagccuggacaccgacggcgccaucaagcugcccagaguggcccacaacggcguguucauccccggcaccuacaagaucgugaucgacaagaagaacaaccugaacgacagaugcacccugaucaccaacugcgugaucaagggcagagaggugagaaagggccagagcgcccugagacaguacaagaccgagaucagaaucggccagaccuucaccggcagcagaagacugcuggccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcaaggagagagccaucgagaccuaccaggccagagagaccuacaccggcaucugccuguucgugcugggcagcgugcuguucgccgugagcuggcugaccaaggcccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacaacaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggcuga

SEQ ID NO: 8620 - RNA, 5094 nt, Artificial Sequence
  derived and/or modified CDS sequence (opt4) from CCHFV(YL16070)__KY354081.1__GP
augcuguuccacuucaaguucaugcugcugaucaacuucauccugugccaccugcuguggggcggcgugggcgugaccggcggcguggagaccaacagcagcagcacccaggccauccccaccccccccgugaccagcaacagcaccacccccggccccagcaccgacaccgccaccgagaccgccagcagcaugaccaccagcacccccgacacccaggugaccaccgacaacggcagcggcgagcccagcaccgacccccugaccaccaacgaggccacccccccccugagcgugaccaccgcccagaccaaggagaccaagaagcacaccacccuggaccccaacaccagcgccaaccccgacgccaccacccccagcaucaccauccugagcgccagcaacaccagccugcccaccagcagcgugcacgccagccccagccccagcagcagcgaggagcccaccccccagaacgcccaccaccugagcagaagccugcugagcgccgugagcaccgagaccggccagaccgccagcgccaccaccgccaccaaggagaucaccaccaagaacagcccccccaccgccggcaacgacaccauggugaccagcgcccccaacggcaacaccagaaacacccccgagcaggccaaccccaccgcccccgaggccagccugaagauccagaccacccagaaccagcagaccgugacccccgaggccacccccaucaccaccgugaccgcccugaccgaccugaccaacagaagcaagagagacagcaaggugcagaucauccugaccuucagccagggccugaagaaguacuacagcaagauccugaagcugcugcagcugacccaggaggaggacagcgagggccugcuggaguggugcaccagagugcuggagcaggccugcgacgacgacuacuucaacaagagaaucgaggaguucuucaucaccggcaagggcuacuucaacgacgugcugcaguucagacugcacgacgcccugagcaacaccgagcccgcccagaccaccagccccaccgccgugcccuucaagagcuacuacgccaagggcagccugaccuucgacagcggcuacuucagcgccagaugcuaccccagagccagcaacagcggccugcagcugaucaacgugacccagcaccccgugaagaucgccaacacccccggccccaagcugagcaaccugaagaccaucaacugcaucaaccugaaggugagcaccgacaaggagcacagcgagcuggaggugaacgugcugcugccccagguggccgugaaccugagcaacugccacgugagcaucaagagccacgugugcgacuacagccuggacaccgacggcgccaucaagcugcccagaguggcccacaacggcguguucauccccggcaccuacaagaucgugaucgacaagaagaacaaccugaacgacagaugcacccugaccaccaacugcgugaucaagggcagagaggugagaaagggccagagcgcccugagacaguacaagaccgagaucagaaucggccagaccgugaccggcagcagaagacugcuggccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugaagagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgugugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaugagccccgugcagagcgcccccgugggcaaggagagagccaucgagaccuaccaggccagagaggccuacaccggcaucugccuguucgugcugggcagcgugcuguucgccgugagcuggcugaccaaggcccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacagcaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcugaagagcuucaagggcuucuucuacggccugaagaacaugcugagcggcaucuucggcaacguguuccugggcauccugcuguuccuggcccccuucgugcugcugaucuucuucuucuucuucggcuggagacugcuguucugccugaagugcugcaagaagaccaagggccugcugaaguacaagcaccugaaggacaaggaggaggccggcuacaagaagaucaucgagagacugaacggcaagaagggcaagagccagcuguucgacggcgagagacuggccaacagaaagaucgccgagcuguucagcaccaagauccacaucggcuga

SEQ ID NO: 8621 - RNA, 5094 nt, Artificial Sequence
  derived and/or modified CDS sequence (opt4) from CCHFV(YL04057)__FJ562094.1__GP
augcuguuccacuucaaguucaugcugcugaucaacuucauccugugccaccugcuguggggcggcggcggcgugaccggcggcguggagaccaacagcagcagcacccaggccauccccaccccccccgugaccagcaacagcaccacccccggccccagcaccgacaccgccaccgagaccgccagcagcaugaccaccagcacccccgacacccaggugaccaccgacaacggcagcggcgagcccagcaccgacccccccaccaccaacgagaccacccccccccccagcgccaccaccgcccagaccaccgagaccaagaagcacaccacccuggaccccaacaccagcaccaaccccgacgccaucacccccagcaucaccauccugagcgccagcaacaccagccugcccaucagcagcgugcacgccagccccagccccagcagcagcgaggagcccaccccccagaacgcccaccaccugagcagaagccugcugagcgccgugagcaccgagaccggccagaucgccagcgccaccaccgccgccaaggagaucaccaccaagaacagcccccccaccgccggcaacgacaccaugaucaccagcgcccccaacggcaacaccagaaacacccccgagcaggccaaccccaccgcccccgaggccagccccaagauccagaccacccagaaccagcagaccgugauccccgaggccacccccaucaccaccaucaccgcccugaccgaccugaccaacagaagcaagagagacagcaaggugcagaucauccugaccuucagccagggccugaagaaguacuacagcaagauccugaagcugcugcagcugacccaggaggaggacagcgagggccugcuggaguggugcaccagagugcuggagcaggccugcgacgacgacuacuucaacaagagaaucgaggaguucuucaucaccggcaagggcuacuucaacgacgugcugcaguucagacugcacgacgcccugagcaacaccgagcccgcccagaccaccagccccaccgccgugcccuucaagagcuacuacgccaagggcagccugaccuucgacagcggcuacuucagcgccagaugcuaccccagagccagcaacagcggccugcagcugaucaacgugacccagcaccccgugaagaucgccaacacccccggccccaagcugagcaaccugaagaccaucaacugcaucaaccugaaggugagcaccgacaaggagcacagcgagcuggaggugaacgugcugcugccccagguggccgugaaccugagcaacugccacgugagcaucaagagccacgugugcgacuacagccuggacaccgacggcgccaucaagcugcccagaaucgcccacaacggcguguucauccccggcaccuacaagaucgugaucgacaagaagaacaaccugaacgacagaugcacccugaccaccaacugcgugaucaagggcagagaggugagaaagggccagagcgcccugagacaguacaagaccgagaucagaaucggccagaccuucaccggcagcagaagacugcuggccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagagagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcaaggagagagccaucgagaccuaccaggccagagagaccuacaccggcaucugccuguucgugcugggcagcgugcuguucgccgugagcuggcugaccaaggcccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacagcaucgccaagggcaagaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcagccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcauccugcuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggcuga

SEQ ID NO: 8622 - RNA, 5094 nt, Artificial Sequence
  derived and/or modified CDS sequence (opt4) from CCHFV(79121M18)__GU477493.1__GP
augcuguuccacuucaaguucaugcugcugaucaacuucauccugugccaccugcuguggggcggcggcggcgugaccggcggcguggagaccaacagcagcagcacccaggccauccagaccccccccgugaccagcaacagcaccacccccggccccagcaccgacaccgccaccgagaccgccagcagcaugaccaccagcacccccgacacccaggugaccaccgacaacggcagcggcgagcccagcaccgacccccugaccaccaacgaggccacccccccccugagcgugaccaccgcccagaccaccgagaccaagaagcacaccacccuggaccccagcaccagcaccaaccccgacgccaccacccccagcaucaccauccugagcgccagcaacaccagccugcccaucagcagcgugcacgccagccccagccccagcagcagcgaggagcccaccccccagaacgcccaccaccugagcagaagccugcugagcgccgugagcaccgagaccggccagaucgccagcgccgccaccgccgccaaggagaucaccaccaagaacagcccccccaccgccggcaacgacaccauggugaccagcgcccccaacggcaacaucagaaacacccccgagcaggccaaccccaccgcccccgaggccagccccaagauccagaccacccagaaccagcagaccgugacccccgaggccacccccaucaccaccaucaccgcccugaccgaccugaccaacagaagcaagagagacagcaaggugcagaagauccugaccuucagccagggccugaagaaguacuacagcaagauccugaagcugcugcagcugacccaggaggaggacagcgagggccugcuggaguggugcaccagagugcuggagcaggccugcgacgacgacuacuucaacaagagaaucgaggaguucuucaucaccggcaagggcuacuucaacgacgugcugcaguucagacugcacgacgcccugagcaacaccgagcccgcccagaccaccagccccaccgccgugcccuucaagagcuacuacgccaagggcagccugaccuucgacagcggcuacuucagcgccagaugcuaccccagagccagcaacagcggccugcagcugaucaacgugacccagcaccccgugaagaucgccaacacccccggccccaagcugagcaaccugaagaccaucaacugcaucaaccugaaggugagcaccgacaaggagcacagcgagcuggaggugaacgugcugcugccccagguggccgugaaccugagcaacugccacgugagcaucaagagccacgugugcgacuacagccuggacaccgacggcgccaucaagcugcccagaguggcccacaacggcguguucauccccggcaccuacaagaucgugaucgacaagaagaacaaccugaacgacagaugcacccugaucaccaacugcgugaucaagggcagagaggugagaaagggccagagcgcccugagacaguacaagaccgagaucagaaucggccagaccuucaccggcagcagaagacugcuggccgagggcggcagcagcgacugcaucagcagaacccagcuggugaagaccgagguggccgagauccacgaggacagcuacggcggccccggcgagaagaucaccaucugcaacggcagcaccaucguggaccagggccugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcaaggagagagccaucgagaccuaccaggccagagagaccuacaccggcaucugccuguucgugcugggcagcgugcuguucgccgugagcuggcugaccaaggcccugaucgacggcaucggcaacagcuucagccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacagcaccgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagaucuaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggcuga

SEQ ID NO: 8623 - RNA, 5088 nt, Artificial Sequence
  derived and/or modified CDS sequence (opt4) from CCHFV(ArD39554)__DQ211628.1__GP
augcugugccacaucaagcacauccugcuguucugcaucauccuguaccaccagcaguggaacaccggcgccagcaacaccaccaucagccccaccaccaacaagagccacaccgacaucagccaccagcccaccagcaucaccgccgccagcagccccggcagccccgccaccaccgccccccccgagagaagcgugacccccagccacacccccaccaccagcgugagcgaggccggcagcggcgagccccccgccgccacccccgccagcgccaccgcccagagccccgagcccgccagcgccgcccagcccagccccaccauccccaagcccaccacccccgaccccaccagcgaggcccugagcacccccgccaccagcagaccccaggagcccagcacccaccccagccccagaagcagccccagcaagcccguggagacccagagcaccagacacaccgccagagagcugcugagcgugaccggcaccgaggccgagcagcugaucacccagaccauccacaccaccaaggaggccaccaaggccaccagcccccagcccaccgccagcaaccccgaccccacccuggccaccaccagcagaagcaucaacagcaucaaccccaagggccccgagagcaccagagccaccccccagagcaccagccccacccccgagagcagcaccauccagacccagauccugcccaucaucaccacccccggcacccuggaggccaucauccaccccaccaacagaagcaagagaaaccugggcaccgagaucauccugacccugccccagggccugaagaaguacuacagcaaggugcugaagcugaugcaccugaccagagaggaggacagcgagggccugcuggaguggugcaccagaauccugggccagaccugcgacgacgacuacuuccagaagagaaucaccgaguucuucaucaccggcgugggcuacuucaacgaggugcugcuguucaaggagaccaccgacgcccccacccuggcccccacccacaagggcgccccccccaccgagcccuucaagagcuacuacgccaagggcuucaucaccauggacagcggcuacuucagcgccaagugcuacagcagagccagcaacagcggccugcagcugaucaacgugaccaugcacagcagcaagaugcccaucacccccggccccaaguacagcaaccugaagaacaucaacugcaucaaccugaaggugagcaccgacaaggagcacaacgagguggagaucaacgugcugcugccccagguggccgugaaccugagcagcugccacgugcuggugagaagccacgugugcgacuacagccuggacgccgacggcaugaucaagcugccccagaucacccacgagggcaccuucauccccggcaccuacaagaucaucaucgacaagaagaacaagcagaacgacagaugcacccugaucaccaacugcgugaucaagggcagagaggugagaaagggccagagcgcccugagacaguacaagaccgagaucagagugggccaggccagcagcggcaccagaagacugcugagcgagagcaacaacaacgacugcgugagcagaacccagcugaucaagaccgagaacgccgagauccacggcgacgacuacggcggccccggcgagaagaucaccaucugcaacggcagcaccaucguggagcagagacugggcagcgagcugggcugcuacaccaucaacagaaucaagagcuucaagcugugcgagaacagcgccagcggcaagggcugcgagaucgacagcacccccgugaagugcaagcagggcuucugccugaagaucacccaggagggcagaggccacgugaagcugagcagaggcagcgagaucauccuggacgugugcgacagcagcugcgagaugaugauccccaagggcagcggcgacauccugguggacugcagcggcggccagcagcacuuccugcaggacaaccugguggaccugggcugccccaacgugccccugcugggcaagauggccaucuacaucugcagaaugagcaaccaccccaagaccaccauggccuuccuguucugguucagcuucggcuacgugaucaccugcaucuucugcaaggugaucuucuacgugcugaucaucaucggcacccugggcaagagaaucaagcaguacagagagcugaagccccagaccugcaccaucugcgaggccacccccgugaacgccaucgacgccgagaugcacgaccugaacugcagcuacaacaucugccccuacugcgccagcagacugaccagcgagggccuggugagacacgugacccagugccccaagagaaaggagaagaucgaggagaccgagcuguaccugaaccuggagagaauccccugguucgugagaaagcugcugcaggugagcgagagcaccggcguggcccugaagagaagcagcuggcuggugacccugcuggugcugcugaccgugagccugagccccgugcagagcgcccccaucggccaggagagaaccguggugaccuaccaggugagagagagcuacaccggcaugugccuguucauccugggcagcgugcuguucgccaucagcuggcugaccaagggccugguggacagcgugggcaacaucuucuuccccggccugagcgugugcaagaccugcagcaucggcagcaucaacggcuucgagaucgagagccacaagugcuacugcagccuguucugcugccccuacugcagauacugcagcgccgacagaggcgcccaccagagccaccugagcgugugcaagaagagaaagaccggcagcaacgugaugcuggccgugugcaagagaaugugcuucagagccacccugaaggugagcagcgaggcccugaucaucagaagcaucaucaacaccaccuucguggugugcauccugauccugguggugugcguggugagcaccagcgccguggagauggagaaccugcccgccggcaccugggagaaggaggaggaccugaccaacuucugccaccaggagugccaggugaccgagaccgagugccugugccccuacgaggccuucgugcugagaaagccccuguuccuggacagcaccgccaagagcaugaagagccugcugaacagcaccagccuggagaccagccugagcaucgaggcccccuggggcgccaucaacgugcagagcaccuucaagcccaccgccagcaccgccaacaucgcccugagcuggagcagcguggagcacagaggcaacaagauccuggugaccggcagaagcgagagcaucaugaagcuggaggagagaaccggcaucagcuggaaccugggcguggaggacgccagcgagagcaagacccugaccgugagcgugauggaccugagccagauguacagcaccguguucgaguaccugagcggcgacagacagguggaggaguggcccaaggccaccugcaccggcgacugccccgagagaugcggcugcaccagcagcaccugccugcacaaggccuggccccacagcagaaacuggagaugcaaccccaccuggugcuggggcgugggcaccggcugcaccugcugcggccuggacgugaagaaccuguucaccgacuacaugcugaucaaguggaagguggaguucaucaagaccgaggccaucgugugcguggagcugaccagccaggagagacagugcagccugaucgaggccggcaccagauucaaccugggccccgugaccaucacccugagcgagcccagaaacauccagcagaagcugccccccgagcuggugacccugcaccccagaguggaggagggcuucuucgaccugaugcacgugcagaaggugcugagcgccagcaccgugugcaagcugcagagcugcacccacggcgugcccggcgaccugcagguguaccacgugggcaaccugcugaagggcgacaagaucaacggcaacagcuuccacaagaucgagcccaaccugaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgagaccccccagcuggaccugaaggccagacccaaguacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagacugcacguggacgagcccgacgagcugaccgugcacgugaagagcgacgaccccgacgugguggccgccagcagcagccugauggccagaaagaucgaguucggcaccgacagcaccuucaaggccuucagcagcaugcccaaggacaagcugugcuucuacaucguggagagagacuacugcagcagcugcagcaaggaggacacccagaagugcgugaacgccaagcuggagcagccccagagcauccugaucgagcacaagggcaccaucaucggcaagcagaacgacaccugcaccgugaaggccagcugcuggcuggagagcgugaagagcuucuucuacggccugaagaacaugcugggcggcaucuucggcaacgugauccugggcaucaucauguuccuggcccccuucgcccugcugcugcuguucuuccuguucggcuggagaauccuguucugccugagaugcugcagaagaaccagaggccuguucaaguacaagcacaucaaggacgacgaggagagcggcuacaagagaaucaucgagagacugaacaacaagaagggcaagaacaagcuguucgacggcgagagacuggccgacaagaagaucgccgagcuguucagcaccaagacccacaucggcuga

SEQ ID NO: 8624 - RNA, 5088 nt, Artificial Sequence
  derived and/or modified CDS sequence (opt4) from CCHFV(AP92)__DQ211625.1__GP
augcccgaccacuucauccugcugcugcugauguacaccguguuccaccagcacccccaggacgugagcgccaacgugcaccuggugaaccccagcaacagcaccaccggcgccagcaccgccuucaaccccgugcacaacgccaccaccgacggccagaagcagagcaccagcaccaccaccauggccagacccagcaccgugacccagaucaccaccgcccaggccauggagguggacggcagcggcgagagcaccacccugcccgccgugacccccacccccgccgagaccaccacccacgccaaccagaagagcgccagcaccaugggcacccugaccaccagccuggaggacaccgcccugaugacccugaccggcagaagcauccugaccagccagagccagaccggcagcuucgacagaaccagcaagccccagacccccagaagcaccaaccagccccugagaaagcugcugagcgccgugagcaccgaggccgccccccagaccagccccaccgccgugaccgccgaccagaccgaggccagcaccagcccccaggugaccaccgacaccagccccagcacccccacccaggugaccagcagcgccggcagcagcagcagcaacaccagcaaccacagcaagaccaccccccagcugaccagcagcggcagcgaggcccagcagacccagcccaccaccaugcccaacaccaccgcccuggugacccccaccgcccacaucagccccaccaacagaagcaagagaaacagcgagguggagaucauccugacccugccccagggccugaagaaguacuacagcaagauccugaagcugcugcaccugacccuggaggaggacagcgagggccugcuggaguggugcaccagaacccugaagcaggccugcgacgacggcuacuuccaggagagaaucaaggaguucuuccugaccggcgagggcuacuucaacgaggugcugcuguucagaagccccagccagcugggcaccaccggcagcccccuggccagcccccccaccgccgagcccuucaagagcuucuacgccaagggcuuccugaucauggacagcggcuacuucagcgccaagugcuaccccaaggccagcaacagcggccugcagcugaucaacaucacccagcacagcaucaagguggugaacacccccggccccaaguacagcaaccugaagaccgugaacugcaucaaccugaaggugagcaccgacaaggaccacagcgagcuggaggugaacgugcugcugccccagguggccgugaacaucagcaacugccacgugcugaucaagagccacgugugcgacuacagccuggacaccgacggcaugaucagacugccccaggugacccacgagggcaccuucauccccggcaccuacaagaucgugaucgacaagaagaacaagcugaacgacagaugcaccaugaccaccaacugcgugaucaagggcaaggaggugagaaagggccagagcacccugagacaguacagaaccgagaucagagugggccagaugagcagcggcaccagaagacugcugagcgagggcggcgacggcggcugcaucagcagaacccagcugaucaagaccgagaccgccgaggugcacggcgacgacuacggcggccccggcgagaagaucaccaucugcaacggcagcaccaucguggaccagagacugggcagcgagcugggcugcuacaccaucaacagaaucaagagcuucaagcugugcgagaacagcgcccagggcaagaacugcgagaucgacagcgcccccgugcagugcagacagggcuacugccugaagaucagccaggagggcagaggccacgugaagcugagcagaggcagcgagaucgugcuggacgugugcgacaccagcugcgagaucaugauccccaagggcaccggcgacauccugguggacugcagcggcggccagcagcacuuccugcagagcaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaagacccuguucuacauccugaucaucaucggcacccugggcaagaagcugaagcaguacagagagcugaagccccagaccugcaccaucugcgagagcgugcccgugaacgccaucgacgccgagaugcacgaccugaacugcagcuacaacaucugccccuacugcgccagcagacugaccagcgagggccugaccagacacgugaaccagugccccaagagaaaggagaagguggaggagaccgagcuguaccugaaccuggagagaauccccuggaucgugagaaagcugcugcaggugagcgagagcaccggcguggcccugaagagaagcagcuggaugaucgugcugcugauccugcugaucgugagcaugagccccgugcagagcgcccccaucagccaggagagaaccguggcccuguaccagagcagagaggacuacaugggcaucugccuggugaucaugggcagcgugcugcuggccgugagccugcuggugagaggccugaucgacagcaucagcagcaccuucuuccccggccugagcgugugcagaaccugccacaucggcagcaucaacggcuucgagaucgagagccacaagugcuacugcggccugcugugcugccccuacugcagagccugcagcaccgaccaggacgcccaccaguuccaccugagcgugugcaagaagagaaaggccggcagcaacgugaugcuggccgugugcaagagaaugugcuucaaggccaucaucgaggccagcaacaaggugcuguucaucagaaacgugaucaacaccaccuucguggugugcauccuggugaugguggccugcaucgccagcagcgccgccguggagauggagaaccugcccgccggcaccugggagagagaggaggagcugaccaacuucugccaccaggagugccaggugaccgagaccgagugccugugccccuacgagagcuucauccugagaaagccccuguuccuggacagcaucgccaagggcgugaagaaccugcugaacagcaccagccuggagaccagccugagcaucgaggcccccuggggcgccaucaacgcccagagcaccuacaagcccaccgccagcagcgccaacaucgcccugaccuggagcagcguggagcacagaggcaacaagauccuggugagcggcagaagcgagagcaucaugaagcuggaggagagaaccggcaucagcuggaaccugggcguggaggacgccagcgagagcagaacccugaccaucagcgugauggaccugagccagauguacagccccguguucgaguaccugagcggcgacagacagguggaggaguggcccaaggccaccugcaccggcaacugccccgagagaugcggcugcaccagcagcaccugccuguacaaggaguggccccacagcagaaacuggagaugcaaccccaccuggugcuggggcgugggcaccggcugcaccugcugcggccuggacgugaaggagcuguucaccgaccacaugcuggugaaguggaagguggaguacaucaagaccgaggccaucgugugcguggagcugaccagccaggagagacagugcagccugaucgaggccggcaccagauucagccugggccccgugaccaucacccugagcgagcccagaaacauccagcagaagcugccccccgagcugaucacccugcaccccaagaucgaggacggcuacuucgaccugaugcacgugcagaaggugaugagcgccagcaccgugugcaagcugcagagcugcacccacggcgugcccggcgaccugcagaucuaccacgugggcaaccugcugaagggcgacagagugaacggccaccugauccacaagguggagccccaccugaacaccagcuggaugagcugggacggcugcgaccuggacuacuucugcaacaugggcgacuggcccagcugcaccuacaccggcgugacccagcacaaccacgccgccuucgccaaccugcugaacaucgagaccgacuacaccaagaccuuccacuuccacagcaagagagugaccgcccacggcgacaccccccagcuggaccugaaggccagacccagauacggcgccggcgagaucaccgugcugguggagguggccgacauggagcugcacaccaagaagguggaggugaccggccugaaguucgccagccugaccugcagcggcugcuacgccugcagcagcggcaucagcugcaaggugagaauccacguggacgagcccgacgagcugaccgugcacgugaagagcagcgaccccgacaucguggccgccagcagcagccugauggccagaaagaucgaguucggcguggacagcaccuucaaggccuucagcagcaugcccaaggacagccugugcuucuacaucguggagagagacuacugcaacagcugcaagaacgaggagacccagagaugcgugaacgccaagcuggagcagccccagagcauccugaucgagcacaccggcaccaucaucggcaagcagaacgacaccugcggcagcagaaccagcugcuggcuggacagcuucaagagcuucuucuacggccugaagagcaugcugagcggcaucuucggcaacguguuccugggcaucuuccuguuccuggcccccuucgcccugcugcuguucuucuucuucuucggcuggagaauccuguucugcuucaagugcugcagaagaaccagaggccuguucaaguacagacacaucaaggacgacgaggaggugggcuacaagaagaucaucgagagacugaacaacaagaagggcaagcacagacugcuggacggcgagagacuggccgacagaaagaucgccgagcuguucagcaccaagacccacaucggcuga

SEQ ID NO: 8625 - RNA, 5085 nt, Artificial Sequence
  derived and/or modified CDS sequence (opt4) from CCHFV(UCCR4413)__KY484038.1__GP
augcugagauacauccuguacgcccugcuggccagcgccauccugcaccagcaccuguacaaggugggcgccgacacccagaagcccaccgugagaaccaacaccacccacaagaucagccccaccgccaccgccaacagaaccaccuacgagcaggccacccccagcaccacccccaagagcagcaccaagcccaccacccacaucgccaccgcccaccuggccgagagcgacggcagcggcgagaccacccugcugcugcccaccaccgccagccaguacaccaccgagggccagaccagccuggagcccaccgccgaggagaccggcagcaacaccauccccagcgacaccaccagcaccagccccaucaccgagaacagcgagagcaccgacacccagaugaacgugagcgacagcagcagcagcccccuggccacccagggcgccagaagccccgccagaaaccugcugagcgugcccagcguggagcccggccagcagaccacccccaagcagcccaccaccaagggcaccgugacccccaccaccccccagcccaccaccagcagccccacccccgcccccaccagcgccacccugagcaccaacagcagcagcaucagcacccccgugcagaccagcagcccccugcagcccauggcccccagccacgagacccagcacgcccuguacaccaccagcaccgagagcacccugagaacccugagcgccgagagaauccaccccaccaacagaagcagaagaaacagcgagguggagaucauccugacccugccccagggccugaagaaguacuacagcagacugcugaagcugcugcaccugaccauggaggaggacaccgagggccugcaggaguggugcgugagagugcugggccagaccugcgacgacagcuacuuccacaagagacuggccgaguucuucaucaccggcaccggcuucuucaacgaggugcugcuguucagaagccccagcacccccaccaccaucaagcccagccccaccggcagccccaccguggagcccuucagaagcuacuacgccaagggcagccugaccaucgacagcggcuacuucagcgccaagugcuaccccagaaccagcaacagcggccugcagcugaucaaccugacccagcacagcguggagaucgccaacacccccggccccaagcacagcagccugaagaccaucaacugcaucaacaucaaggccagcaccgacaaggagcacaacgagguggagaucaacgugcugcugccccagguggccaucaaccugagcaacugccacgugagcaucagaagccacgugugcgacuacagccuggacaccgacggcaagaucagacugccccagaucagccacgagggcaccuucauccccggcaccuacaagaucaucaucgacaagaagaacaagcugaacgacagaugcagccugaucaccagcugcgugaucaagggcagagagcugagaaagggccagagcacccugagacaguacaagaccgagaucaagaucggccagaccagcagcggcagcagaagacugcugagcgagagcagcgccagcggcugcaucagcagaacccagaugaucaagagcgagaccgccgagauccacgacgacaucuacggcggccccggcgagaagcugaccaucugcaacggcaccaccgugguggaccagagacugggcagcgagcugggcugcuacaccaucaacagaaucaagaccuacaagcugugcgagaacagcgugaaggagaagaccugcgagaucgacagcgugcccgugaagugcagacagggccugugccugaagaucacccaggagggcagaggccacgugaagcugagcagaggcagcgagaucgugcuggacaucugcgacagcagcugcgagcugaugauccccaagggcaccggcgacauccugguggacugcagcggcggccagcagcacuuccugcaggacaaccugguggaccugggcugccccaacaucccccugcugggcaagguggccaucuacaucugcagaaugagcaaccaccccaagaccaccauggccuuccuguucugguucagcuucggcuacgugaucaccugcauccugugcaagauccuguucuaccugcugaucaucaccggcacccugggcaagaagcugaagcaguacagagagcugaagccccagaccugcaccaucugcgagagcacccccgugaacgccaucgacgccgagaugcacgaccugaacugcagcuacaacaucugccccuacugcgccagcagacugaccagcgacggccugaucagacacgugaaccugugccccaagagaaaggagaagguggaggagaccgagcuguaccugaaccuggagagaauccccugguucgugagaaagcugcugcaggugagcgagagcaccggcguggcccugaagagaagcagcuggcugcugauccuggugauccugcugaccgugagcaugagccccgugcagagcgcccccaucaaccagcagagagccguggaggccuaccaggccagagagggcuacaccggcaucugccuguucauccugggcagcgugcuguucaugaccagcuggcugaccaagggccugaucgacagcaucggcgacagcuucuuccccggccuguucgugugcaagaccugcagcaucggcagcaucaacggcuucgagaucgagagccacagaugcuacugcagccugcugugcugccccuacugcagaaccugcagcgccgacaaggacagccaccagcugcaccugagcaucugcaagaagaagaaggccggcagcaacgugaugcuggccgugugcaagagaaugugcuucaaggccaccaucgaggccagcaacagagugcugcugaucagaagcaucaucaacaccaccuucaucaucugcaugcugauccugguggugugcgugaucagcaccagcgccguggagauggaggaccugcccgccggcaccugggagagagaggaggaccugaccaacuucugccaccaggagugccaggugaccgagaccgagugccugugccccuacgaggccuucgugcugagaaagccccuguuccugagcagcaucgugaagggcaagaagaaccugcugaacagcgccagccuggagaccagccugagcaucgaggcccccuggggcgccaucaacgcccagagcaccuucaagcccaccaucagcaccgccaacaucgcccugagcuggagcagcguggagcacagaggcaacaaggugcuggugagcggcagaagcgagagcaucaugaagcuggaggagagaaccggcaucagcuggaaccugggcguggaggacgccagcgagagcagaaugcugaccgugagcgugauggaccugagccagauguaccugcccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugcccagcgagaucgugacccugcaccccaagaucgaggagggcuucuucgaccugaugcacgugcagaaggugcugagcgccagcaccgugugcaagcugcagagcugcacccacggcguggccggcgaccugcagguguaccacgugggcaaccugcugaagggcgacaagaucaacggccacagcauccacaagaucgagccccaccugaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagagcuuccacuuccacagcaagagagugaccgcccacggcgacaccccccagcuggaccugaaggccagacccauguacggcgccggcgagaucaccgugcugguggagguggccgacauggagcugcacagcaagaacaucgagaucagcggccugaaguucgccagccugaccugcagcggcugcuacgccugcagcagcggcaucagcugcaaggugagaauccacguggacgagcccgacgagcuggccgugcacgugaagagcgacgaccuggacgugguggccgccagcagcagccugauggccagaaagaucgaguucggcaccgacagcaccuucaaggccuucagcagcaugcccaaggagagccugugcuucuacaucguggagagagacuucugcaagagcugcgccgccgaggacacccagaagugcgugaaggccaagcuggagcagccccagagcauccugaucgagcacaagggcaccaucaucggcaagcagaacgacaccugcagcaccaagaccagcugcuggcuggagagcuucaagagcuucuucuacggccugaagaacaugcugagcggcguguucggcagcgccaucaugggcauccugcuguuccuggcccccuucauccugcugauccuguucuucuucuucggcuggagaauccuguucugccugagaugcugcagaagaaccagaggccuguucaaguacaagcacaucaaggacgacgaggaggccggcuacaagaagaucaucgagaagcugaacaacaagaagggcggcaccagcaagcugcuggacggcgagagacuggccgacagaaagaucgccgagcuguucagcaccaaggcccacaucggcuga

SEQ ID NO: 8626 - RNA, 5076 nt, Artificial Sequence
  derived and/or modified CDS sequence (opt4) from CCHFV(SCT ex Afghanistan)__KC344856.1__GP
augcaccacgccuaccagaucauguacacccugcuggugugcgccauccugugcccccagcccuggagccuggagggcacccacgugccccugaacggcaccaagcacaacggcaccggcaucaccgccgcccccggcggcagccagggccccaccagccccgccagcaccgccgugagccugacccccgaccccuucaccaccgagcccaccgccagcgccguggagcuggagagcagcggcgagggccacaccagccugagcgugaccacccagggccugaccagccccgagaccacccccggccugcccaccgugaccgacaccggcgugagcagcaccagcaucuucggcaucggcaucagaguggccggcgacacccccaccagcaccacccacaccggccugcccagcagccccagcaugcccagcaccgcccagggcccccaccacgccgugagaggccugcugagcgugagcagcaccagacccggcgaggccagcaccaucaccgugcccggcgaggccggcaccgaggccaacagcagcagcagcgccaucagcaagaagcccgcccccagccccaccgccgaggccaucaccgaggccaacaacagcagcaaccccagacagcccgagcugagcacccagcccgccauccccggccuggugaccagcagcgcccagcccauccugcugcagagcgccaccagcaccgccgcccaggacaucuaccccagccccaccaacagaagcaagagaaaccuggagauggagaucauccugacccugagccagggccugaagaaguacuacggcaagauccugagaauccuggaccugacccuggaggaggacaccgagggccugcuggaguggugcaagagaaaccugggccugaccugcaacgacaacuucuuccaggagagaaucgaggaguucuuccugaccggcgagggccacuucaacgaggugcugcaguucaagacccccagcacccugagccccaccgagcccacccacaccagaacccccaccgugaagcccuucaagagcuacuucgccagaggcuuccugagcaucgacagcggcuacuucagcgccaagugcuacagcaagaccagcaacagcggccugcagcugaucaacaucacccagcaccccgccagaaucgccgacacccccggccccaagaucaccaaccugaaggccaucaacugcaucaaccugaaggccagcguguucaaggagcacagagagaucgagaucaacgugcugcugccccagguggccgugaaccugagcaacugccacgugcugaucaagagccacgugugcgacuacagccuggacaucgacggcgccgugagacugccccacgugcaccacaagggcaccuucauccccggcaccuacaagaucgugaucgacaagagaaacaagcagaacgacagaugcacccuggugaccaacugcgugaucaagggcaaggagaucagaaagggccagagcgcccugagacaguacagaaccgagaucagaaucggcaaggccagcgccggcagcagaagacugcugagcgaggagagcggcgacgacugcaucagcagaacccagcugcugagaaccgagaccgccgaggugcacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcaagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggugaucuucuaccugcugaucguggugggcacccugggcaagaaguucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaucagcgugugccuguucgugcugggcggcauccuguucguggugagcugccugaucaagggccugguggacagcgugggcaacagcuucuuccccggccugagcaucugcaagaccugcagcaucggcagcgugaacggcuucgagaucgagagccacaagugcuacugcagccugcugugcugccccuacugcagacacugcagcaccgacagagagauccaccagcugcaccugagcaucugcaagaagagaagaaccggcggcaacgugaugcuggccgugugcaagagaaugugcuucagagccaccauggaggugagcaacaaggugcuguucaucagaaacaucaucaacaccaccuucgugaucugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccugaacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagagccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaagcugaacggccacaugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgacaucagcggccugaaguucgccagccugaccugcgccggcugcuacgccugcagcagcggcaucagcugcaaggugagaauccacguggacgagcccgacgagcugaccgugcacgugaagagcgaggaccccgacaucguggccgccagcaccagccugaucgccagaaagcuggagcugggcaccgacagcaccuucaaggccuucagcgccaugcccaagaccagccugugcuucuacaucguggagagagaguacugcaagagcugcagcaaggaggacacccagaagugcgugaacaccaagcuggagcacccccagggcauccugaucgagcacaagggcaccaucaucggcaagcagaacgacaccugcaccgccaaggccggcugcuggcuggagagcgugaagagcuucuucuacggccugaagaacaugcugagcggcaucuucggcaacguguucaucggcaucuuccuguuccuggcccccuucgugcugcugauccuguucuucauguucggcuggagacugcuguucugcuucaagugcugcagaagaaccagaggccuguucaaguacagacaccugaaggaggacgaggagagcggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8627 - RNA, 5070 nt, Artificial Sequence
  derived and/or modified CDS sequence (opt4) from CCHFV(SPU 431/85)__KJ682812.1__GP
augcccgugaacaucauguacaccccccuggugugcgccgugaucugccugcagcuguggaaccugggcggcacccuggugagcaccaacagaacccagcacaacgagaccggcaccguggccacccccgagggcacccugagacccagacugcccgugagcaccgcccugcccaccaagagcgacagacccagcgugggccccgccgccagcagcagcggccuggagggcagcggcgagcccaacaccagccccagcaucaccaccaagggccugaccccccccgagaccacccccgcccugcccaccgccaccgacaccgacgccagcagcaccggcgugguggacgugagcacccagaugaccaaggacauccccaugagcaccgccuacaccaacccccccagcacccccagcgcccccagcaccccccagggcacccaccacaccgccagaggccugcugagcguggccagcaccaagagcgaggaggugagcaugagcaccagccccgccaagaccagcaccgagaccagcagccccccccccgccaccagcgagacccccacccccagccccaccacccaggugcccaccggcaacaacaaccccaacaccagcagacagcccacccccagcgcccagcccgccaugagcaaccccgccaccagccccgcccagcccaaccugagccagagcgccccccccaccgccgaccagggcgugcaccccagccccaccaacagaagcaagagaaaccuggagaucgagaucauccugacccugagccagggccugagaaaguacuacggcaagauccugaagcugcuggaccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaaggugcccagcacccugagcagcaccgagcccacccacaccagaccccccaccguggagcccuucaagagcuacuucgccaagggcuuccugagcaugaacagcggcuacuucagcgccaagugcuaccccagaaccagcaacagcggccugcagcugaucaacgugaccaagcacagcgccaagaucgccgacacccccggccccaagaucaccaaccugaagaccaucaacugcaucaaccugagagccagcguguucaaggagcacagagagguggagaucaacgugcugcugccccagguggccgugaaccugagcaacugccacgcccagaucaagagccacgugugcgacuacagccuggccaccgacggcauggugagacugccccacauccaccacgagggcaccuucauccccggcaccuacaagaucgugaucgacaagaagaacaagcagaacgacagaugcacccuggugaccaacugcgugaucaagggcagagaggugagaaagggccagagcgcccugagacaguacaagaccgagaucagaaucggcaaggccagcagcggcagcagaagacugcugagcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucguggugagcugccuggugaagggccugaucgacagcgugggcaacagcuucuuccccggccugagcaucugcaagaccugcagcaucggcagcaucaacggcuucgagaucgagagccacaagugcuacugcagccuguucugcugccccuacugcagacacugccccgccgacagagagauccacaagcugcaccugagcaucugcaagaagagaaagaccggcagcaacgugaugcuggccgugugcaagagaaugugcuucagagccaccaucgaggugagcaacagagcccugcugaucagaaacaucaucaacaccaccuucguggugugcauccugacccuggccgugugcguggugagcaccagcgccguggagauggagagccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcagaaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggcuga

SEQ ID NO: 8628 - RNA, 5070 nt, Artificial Sequence
  derived and/or modified CDS sequence (opt4) from CCHFV(SPU 556/87)__KJ682811.1__GP
augaccgugaacaccgugugcaccccccuggugugcgccguguucugccugcagcuguggaaccugggcggcacccuggugcccaccaacagaacccagcacaacaagaccggcaccauggccacccccgagggcacccugggccccagacugcccgugagcaccgcccugcccaccaagagcgacagacccagcgugggccccgccgcccccagcagcggccuggagggcagcggcgagcccaacaccagccccagcaucaccaccaagggccuggcccugcccgagaccacccccgccccccccaccgccaccgacaccgacgccagcagcaccggcguggugaacgugagcacccagaugaccaaggacauccccaugagcaccgccuacaccaacccccccagcacccccagcgcccccagcaccccccagggcacccaccacaccgccagaggccugcugagcguggccagcaccaagagcgaggaggugagcaugagcaccagccccggcaagaccagcaccgagaccagcagccccccccccgccaccagcgagacccccgcccccagccccaccacccaggcccccaccggcaacaacaaccccaacaccagcagacagcccacccccagcgcccagcccgccaugagcaaccccaccaccagccccgcccagcccaaccugcugcagaacgccccccccaccgccgaccagggcgugcaccccggccccaccaacagaagcaagagaaaccuggagauggagaucauccugacccugagccagggccugagaaaguacuacggcaagauccugaaguuccuggaccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaaggugcccagcacccugagcagcaccgagcccacccacaccggcagccccaccguggagcccuucaagagcuacuucgccaagggcuuccugagcaugaacagcggcuacuucagcgccaagugcuaccccagaaccagcaacagcggccugcagcugaucaacgugaccaagcacagcgccaagaucgccgacacccccggccccaagaucaccaaccugaagaccaucaacugcaucaaccugagagccagcguguucaaggagcacagagagguggagaucaacgugcugcugccccagguggccgugaaccugagcaacugccacgcccagaucaagagccacgugugcgacuacagccuggccaccgacggcauggugagacugcccagaauccaccacgagggcaccuucauccccggcaccuacaagaucgugaucgacaagaagaacaagcagaacgacagaugcacccuggugaccaacugcgugaucaagggcagagaggugagaaagggccagagcgcccugagacaguacaagaccgagaucagaaucggcaaggccagcagcggcagcagaagacugcugagcgaggagagcgacggcgacugcaucagcagaacccagcugcugagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcagcugcgagaucaugauccccaagggcaccggcgacauccugguggacugcagcggcggccagcagcacuuccugaaggacaaccugaucgaccugggcugccccaacaucccccugcugggcagaauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucaucgugagcugccuggugaagggccugaucgacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacaagcugcaccugagcaucugcaagaagagaaagaccggcagcaacgugaugagcgccgugugcaagagaaugugcuucagagccaccaucgaggugagcaacagagcccugcugaucagaagcaucaucaacaccaccuucgccgugugcauccugacccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacacccagaagugcgugaacaccaagcuggagagaccccagagcauccugaucgagcacaagggcaccaucaucggcaagcagaacgacaccugcaccgccaaggccagcugcuggcuggagagcgugaagagcuucuucuacggccugaagagcaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggcuga

SEQ ID NO: 8629 - RNA, 5070 nt, Artificial Sequence
  derived and/or modified CDS sequence (opt4) from CCHFV(SPU 18/88)__KJ682810.1__GP
augcccuucaacaucauguacaccccccugcugugcgccauccugugccugcagcuguggagccuggagggcaucuacggccugagcaacaagacccagcacaacgacaccagcaccaucaaggugcccgaggagagccagaagaccagccugcccgccaacaccgccagccccaucaccagcgaccccagcagcgccaccagcaccgcccuggccagcggccccgagggcagcggcgacaccagcaccagccccagcgugaccacccagggccccacccugcuggagaccacccccgagccccacaccaccaucgacaucgacgagagcagcaccgccaucgccgacaucagcacccagaccgugaaggacauccccacccccaccacccacaccagccugcccagcacccccagcgcccccaccaucccccaggaggcccaccacaccgccagaggccugcugagcgugaccagcaccaagcccggcgagaccagcacccccaccagccccggcgaggccagcaccgaggccagcagcccccagcccaccaucagcgagacccccagccccccccccaccacccaggcccccaccgagaucaacaaccccaacaccagcagacagcccaugcccagcacccagcccgccgcccccaacagcgugaccccccccgugcagcccaccuucagccagagcgacgugagcaccguggcccaggacauccaccccagccccaccaacagaagcaagagaaaccuggagauggagaucauccugacccugagccagggccugaagaaguacuacggcaaggugcugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugagcauggacagcggcuacuucagcgccaagugcuaccccaagagcagcaacagcggccugcagcugaucaacgugacccagcacagcaucagaaucaccgacacccccggccccaagaucaccagccugaagaccaucaacugcaucaaccugaaggcccugguguucaaggagcacagagagaucgagaucaacgugcugcugccccagguggccgugaaccugagcaacugccacgugcugaucaagagccacgccugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugggcuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucagccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccggcaaggccggcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaagaacaagaagggcaagaacaagcugcuggacggcgagagacuggccgacagaaagaucgccgagcuguucagcaccaagacccacaucggcuga

SEQ ID NO: 8630 - RNA, 5070 nt, Artificial Sequence
  derived and/or modified CDS sequence (opt4) from CCHFV(SPU 497/88)__KJ682808.1__GP
augcccuucaacaucauguacaccccccugcugugcgccauccugugccugcagcuguggagccuggagggcaucuacggccugagcaacaagacccagcacaacgacaccagcaccaucaaggugcccgaggagagccagaagaccagccugcccgccaacaucgccagccccaccaccagcgacccccccagcgccaccagcaccgccagcgccagcggccccgagggcagcggcgacaccagcaccagccccagcgugaccacccagggccccaccccccuggagaucacccccgagccccacaccaccaucgacaucgacaagagcagcaccagcaucgccgacaucagcaccagaaccgugaaggacauccccacccccaccacccacaccagccugcccagcacccccagcgcccccaccaucccccaggaggugcaccacaccgccagaggccugcugagcgugaccagcaccaagcccgaggaggccagcacccugaccagccccggcgaggccagcaccgaggccagcagcccccagcccaccaucagcgagacccccagccccccccccaccacccaggcccccaccgagaucaacaaccccaacaccagcagacagcccaugcccagcacccagcccgccgcccccaacagcgugaccccccccgugcagcccaccuucagccagagcgacgugagcaccgccgcccaggacauccaccccagccccaccaacagaagcaagagaaaccuggagauggagaucauccugacccugagccagggccugaagaaguacuacggcaaggugcugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugagcauggacagcggcuacuucagcgccaagugcuaccccaagagcagcaacagcggccugcagcugaucaacgugacccagcaccugaucagaaucaccgacacccccggccccaagaucaccaaccugaagaccaucaacugcaucaaccugaaggcccugguguucaaggagcacagagagaucgagaucaacgugcugcugccccagguggccgugaaccugagcaacugccacgugcugaucaagagccacgugugcgacuacagccuggacaucgacggccccgugagacugcccagaauccaccacgagggcaccuucauccccggcaccuacaagaucgugaucgacaagaagaccaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcaagggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcggcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccuggagcaacgugaugcuggccgugugcaagagaaugugcuucagagccaccguggaggugagcaacaaggcccugcugaucagaaacaucaucaacaccaccuucguggugugcauccugauccuggccaucugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugagaaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccagagccagcugcuggcuggagagcaucaagagcuucuucuacggccugaagaacaugcugagcggcaucuucggcaacguguucaucggcaucuuccuguucuucgcccccuucaucaugcugauccuguucuucauguucggcuggagaauccuguucugcuucaagugcugcagaagaaccagaggccuguucaaguacagacaccugaaggacgacgaggaggugggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8631 - RNA, 5070 nt, Artificial Sequence
  derived and/or modified CDS sequence (opt4) from CCHFV(SPU 130/89)__KJ682807.1__GP
augcccuucaacaucauguacaccccccugcugugcgccauccugugccugcagcuguggagccuggagggcaucuacggccugagcaacaagacccagcacaacgacaacagcaccaccaaggcccccgaggagagccacaagaccagccugcccgccaacaccgccagccccaucaccagcgacccccccagcaccaccagcaccaccagcgccagcggccccgagggcagcggcgacaccagcaccagcccccccgugaccacccagggccccgccagccccgagaccacccccgagccccacaccaccaucgacaucgacaagagcagcaccgccaucgccgacaucagcacccagaccgugaaggacauccccacccccaccacccacaccagccugcccagcacccugagcgcccccaccaucccccaggaggcccaccacaccgccagaggccugcugagcgugaccagacacaagcccggcgaggccagcaagcccaccagccccggcgaggccagcaccgaggccagcagcagccagcccaccaucagcgagacccccagccccccccccaccacccaggcccccaccgagaucaacaaccccaacaccagcagacagcccaugcccagcacccagcccgccgcccccagcagcgugacccaccccgcccagcccacccccagccagagcgacgugcccaccgccgcccaggacauccaccccagccccaccaacagaagcaagagaaaccuggagauggagaucauccugacccugagccagggccugaagaaguacuacggcaaggugcugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugagcauggacagcggcuacuucagcgccaagugcuaccccaagagcagcaacagcggccugcagcugaucaacgugacccagcaccugaucagaaucaccgacacccccggccccaagaucaccaaccugaagaccaucaacugcaucaaccugaaggcccugguguucaaggagcacagagagaucgagaucaacgugcugcugccccagguggccgugaaccugagcaacugccacgugcugaucaagagccacgugugcgacuacagccuggacaucgacggccccgugagacugcccagcauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagcccaacuacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccugagccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagagcacugcaagagcugcagcaaggaggacacccagagaugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcguguuccuguuccuggcccccuucaucauccugauccuguucuucauguucggcuggagaauccuguucugcuucaagugcugcagaagaaccagaggccugcugaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8632 - RNA, 5070 nt, Artificial Sequence
  derived and/or modified CDS sequence (opt4) from CCHFV(SPU 383/87)__KJ682806.1__GP
augcccuucaacaucauguacaccccccugcugugcgccauccugugccugcagcuguggagccuggagggcaucuacggccugagcaacagaacccagcacaacgacaccagcaccaucaaggugcccgaggagagccagaagaccagccugcccgccaacaccgccagccccaucaccagcgacccccccagcaccaccagcaccgccagcgccagcggccccgagggcagcggcgacaccagcaccagcccccccgugaccacccagggccccaccccccccgagaccacccccgagccccacaccaccaucgacaucgacaagagcagcaccgccaucgccgacaucagcacccagaccgugaaggacauccccacccccaccacccacaccagccugcccagcacccugagcgcccccaccaucccccaggaggcccaccacaccgccagaggccugcugagcaucaccagcaccaagcccggcgaggccagcacccccaucagccccggcgaggccagcaccgaggccagcagcccccagcccaccaucagcgagacccccagccccccccccaccgcccaggcccccaccgagaucaacagccccaacaccagcagacagcccaugcccagcacccagcccgccgcccccaacagcgugacccaccccgcccagcccacccccagccagagcgacgugcccaccgccgcccaggacauccaccccaaccccaucaacagaagcaagagaaaccuggagauggagaucauccugacccugagccagggccugaagaaguacuacggcaaggugcugaagcugcuggaccugacccuggaggaggacaccgagggccugcuggagagcugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugagcauggacagcggcuacuucagcgccaagugcuacagcaagagcagcaacagcggccugcagcugaucaacgugacccagcaccugaucagaaucaccgacacccccggccccaagaucaccaaccugaagaccaucaacugcaucaaccugaaggcccugguguucaaggagcacagagagaucgagaucaacgugcugcugccccagguggccgugaaccugagcaacugccacgugcugaucaagagccacgugugcgacuacagccuggacaucgacggccccgugagacugcccagaauccaccacgagggcaccuucauccccggcaccuacaagaucgugaucgacaagaacaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcuggugguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugauccagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucuucggcaagcagaacgacaccugcaccgccaaggccagcugcuggcuggagagcgugaagagcuucuucuacggccugaagaacaugcugagcggcaucuucggcaacguguucaucggcguguuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8633 - RNA, 5070 nt, Artificial Sequence
  derived and/or modified CDS sequence (opt4) from CCHFV(SPU 44/08)__KJ682805.1__GP
augcccuucaacaucauguacaccccccugcugugcgccauccugugccugcagcuguggagccuggagggcaucuacggccugagcaacaacacccagcacaacgacaccagcaccaucaaggugcccgaggagagccagaagaccagccugcccgccaacaccgccagccccaucaccagcgaccccccccccaccacccccaccgccagcgccagcggccccgagggcagcggcgacaccagcaccagcccccccgugaccacccagggccccaccccccccgagaccacccccgagccccacaccaccaucgacaucgacaagagcagcaccgccaucgccgacaucagcacccagaccgugaagaacauccccacccccaccgcccacaccagccugcccagcacccugagcgcccccaccaugccccaggaggcccaccacaccgccagaggccugcugagcgugaccagcaccaagcccggcgaggccagcacccccaccagccccggcgaggccagcaccgaggccagcagcccccagcccaccaucagagagacccccagccccccccccaccacccagacccccaccgagaucaacaaccccaacaccagcagacagcccaugcccagcacccagcccgccgcccccagcagcgugacccaccccgcccagcccacccccagccagagcgacgugcccaccgccgcccaggacauccaccccagccccaccaacagaagcaagagaaaccuggagauggagaucauccugacccugagccagggccugaagaaguacuacggcaaggugcugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugcugauggacagcggcuacuucagcgccaagugcuaccccaagagcagcaacagcggccugcagcugaucaacgugacccagcaccugaucagaaucaccgacacccccggccccaagaucaccaaccugaagaccaucaacugcaucaaccugaaggcccugguguucaaggagcacagagagaucgagaucaacgugcugcugccccagguggccgugaaccugagcaacugccacgugcugaucaagagccacgugugcgacuacagcaucgacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugagaggccugguggacagcgugagcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8634 - RNA, 5070 nt, Artificial Sequence
  derived and/or modified CDS sequence (opt4) from CCHFV(Matin)__AF467769.2__GP
augagcuucaacaucauguacacccugcugcugugcgccauccugugcagccagcuguggagcagcgagggcauccacggccugagcaacgagacccagcacggcaacgccagcaccaucaaggcccccgaggugagccagggccugggccugcccgugagcaccgccccccccaucaccagcgacccccccagcaucaccagcgccgccagcgugagcggccccgagggcagcggcgacaccaacaccagcccccccgugaccacccagggccugacccugcccgagaccacccuggagcugcugaccaccaccaacaccggcgccagcagcaccgugaucguggacgugagcacccagaccgugaaggacacccccgugagcaccgcccacaccagcccccccggcacccccagcgcccccaccaccccccagggcacccaccacaccgccagaggccugcugagcgugaccagcaccaagagcgaggaggccagcacccagaccaaccccaagaagaccagcauggagaccaacagccccggccccgccaccagcgagacccccagccccagccccaccacccaggcccccaccgagaacaacaaccccaacacccccagacagcccaccccccccacccagcccgccacccccagccccgugaccagccccgcccugcuggccagcagccagggcgacaccagcaccgccgugcaggacgugcaccccagccccaccaacagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacagcuucuuccagaagagaaucgaggaguucuuccugaccggcgagggccacuucaacgaggugcugcaguucaagacccccagcacccugagccccaccgagcccgccagagccggcagccccaccguggagcccuucaagagcuacuucgccagaggccugcugagcauggacagcggcuacuucagcgccaagugcuaccccagagccagcaacagcggccugcagcugaucaacaucacccagcacagcgccagaaucaccgacacccccggccccaagaucaccaaccugaagaccaucaacugcaucaaccugaaggccagcaccuucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcaccaucgugaccaacugcgugaucaagggcagagagaucagaaagggccagagcgugcugagacaguacaagaccgagaucaagaucggcaaggccagcagcggcagcagaagacugcugagcgaggagagcggcgacgacugcaucagcagaacccagcugcugagaaccgagaccgccgagauccacagcgacagcuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaucagagagggcuacaccagcgugugccuguucgugcugggcagcauccuguucaucgugagcugccugaugaagggccugguggacagcgacggcaacagcuucuuccccggccugagcaucugcaagaccugcagcaucggcagcaucaacggcuucgagaucgagagccacaagugcuacugcagccuguucugcugccccuacugcagacacugcagcaccgacagagagauccacaagcugcaccugagcaucugcaagaagagaaagaccggcagcaacgugaugcuggccgugugcaagagaaugugcuucagagccaccguggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaucaacuucugccaccaggagugccaggugaccgagaccgagugccugugccccuacgaggcccuggugcugagaaagccccuguuccuggacagcaucaucaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggugaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugagcaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucgcccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacgugggcuga

SEQ ID NO: 8635 - RNA, 5070 nt, Artificial Sequence
  derived and/or modified CDS sequence (opt4) from CCHFV(TADJ/HU8966)__AY179962.1__GP
augcccgugagcaucaugcacaugcugcugaugugcgccgugcugugccugcagcuguacggccugggcggcacccugagaagcaacaacggcaccgagcacaacaagaccaacgugcugaccacccccggcgacaagcugagccccgagccccccgugagcaccgcccugcccgugacccccgacagcagcaccgugacccccaccacccccgccagcggccuggagggcagcggcgagguguacaccagcccccccaucaccaccaagggccugagccccagcgaggccaccagcgagccccccgccaccaccggcaugggcaucagcagcgccagcggcguggacuucagcacccaggccgccagagacaccagcacccugaccgugcugaccagcccccccaacagccccaacaccccccccaccagccaggacacccaccaccccgugagaagccugcugagcgugaccagccccagacccgaggagaccaccgcccccagcaagagcggcaaggagagccccgccgccaacagcagccaccccgugaccagcagacccagcagcccccugaucaccgugagaggccccaccgagaacagcagccacaacaccaccggccagcuggagagcaugacccagagcaccacccuggugcccauggccagccccacccagaccgugcugagccagagcgugaccagcaucgccgugcaggacgcccaccccagcagcaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccggcagccccaccgccgagcccuucaagagcuacuucgccaagggcuuccugagcaucgacagcggcuacuucagcgccaagugcuacagcagaaccagcaacagcggccugagacugaucaacgugaccagacacagcaccagaaucgccgacacccccggccccaagaucaccaaccugaagaccaucagcugcaucaaccugagagccagcaucuucaaggagcacagagagguggagaucaacgugcugcugccccagguggccgugaaccugagcaacugccacguggccaucaagagccacgugugcgacuacagccuggacguggacggcaccgugagacugccccacauccaccacggcggcaccuucauccccggcaccuacaagaucgugaucgacaagaagaacaagcugaacgacagaugcacccuguucaccaacugcgugaucaagggcagagaggugagaaagggccagagcauccugagacaguacaagaccgagaucagaaucggcaaggccagcaccggcagcagaagacugcugagcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugaagaucacccaggagggcagaggccacgugaagcugagcagaggcagcgagguggugcuggacgccugcgacagcagcugcgaggugaugauccccaagggcaccggcgacaucagcguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccagaauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagagaguggaggagaccgagcuguaccugaaccuggagagaauccccuggaucgugagaaagcugcugcaggugagcgagagcaccggcguggcccugaagagaagcagcuggcugaucgugcugcuggugcuguucaccgugagccugagccccgugcagagcgcccccaucggcuacggcaacaccaucgagaccuaccaggccagagaggaguacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaacccccugaacagcaccagccuggagaccagccugagcaucgaggcccccuggggcgccaucaacgugcagagcaccuacaagcccaccgugagcaccgccaacaucgcccugagcuggagcagcaucgagcacagaggcaacaacauccuggugagcggcagaagcgagagcaucaugaagcuggaggagagaaccggcaucagcggcgaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaucgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggagaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacagaaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccugagcugcuucaagugcugcagaagaaccagaggccugcugaagcacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8636 - RNA, 5070 nt, Artificial Sequence
  derived and/or modified CDS sequence (opt4) from CCHFV(88166)__AB069675.1__GP
augagcuucagcgugauguacaccccccugcugugcgccgugcugugccugcagcuguggagccuggagggcagccacggccugagcaacaagacccagcacagcaacaccagcaccaccaaggcccccgaggugagccaggagcugggccugcccgugagcaccgugagcaccaucaccagcgacccccccagcaucaccagcgccgugagcgugagcggcagcgagggcagcggcgacaccaacaccagccccagcgugaccacccagggccccacccugcccgagaccacccuggagccccugaccaccaccgacaccgacgccagcagcaccguggugguggacgugagcacccagaccgugaaggacacccccaucagcaccaccuacaccagccugcccagcacccccagcgagcccaccaccccccagggcacccaccacaccgccagaggccugcugagcgugaccagcaccaagcccgaggaggccagcacccaggccaaccccggcaagaucagcauggagaccaacagccccagacuggccaucagcgagacccccagcuucagccccaccacccaggcccccaccgagaacagcaaccccaucaccagcaagcagcugaugcugagcgcccagcccgugacccccaaccccaugaccagccccgugcagcccgcccugagccagagcgacaccagcaccgccauccaggacauccaccccagccccaccggcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacaacuucuuccagaagagaaucgaggaguucuuccugaccggcaagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaagaucaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccuggagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgaccugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8637 - RNA, 5070 nt, Artificial Sequence
  derived and/or modified CDS sequence (opt4) from CCHFV(8402)__AB069674.1__GP
augagcuucagcgugauguacaccccccugcugugcgccgugcugugccugcagcuguggagccuggagggcagccacggccugagcaacaagacccagcacagcaacaccagcaccaccaaggcccccgaggugagccaggagcugggccugcccgugagcaccgugagcaccaucaccagcgacccccccagcaucaccagcgccgugagcgugagcggcagcgagggcagcggcgacaccaacaccagccccagcgugaccacccagggccccacccugcccgagaccacccuggagccccugaccaccaccgacaccgacgccagcagcaccguggugguggacgugagcacccagaccgugaaggacacccccaucagcaccaccuacaccagccugcccagcacccccagcgagcccaccaccccccagggcacccaccacaccgccagaggccugcugagcgugaccagcaccaagcccgaggaggccagcacccaggccaaccccggcaagaucagcauggagaccaacggccccagacuggccaucagcgagacccccagcuucagccccaccacccaggcccccaccgagaacagcaaccccaucaccagcaagcagcugaugcugagcgcccagcccgugacccccaaccccaugaccagccccgugcagcccgcccugagccagagcgacaccagcaccgccauccaggacgugcaccccagccccaccggcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacaacuucuuccagaagagaaucgaggaguucuuccugaccggcaagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaagaucaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8638 - RNA, 5070 nt, Artificial Sequence
  derived and/or modified CDS sequence (opt4) from CCHFV(7803)__AB069672.1__GP
augcccgugagcaucaugcacaucagccugaugugcgccgugcugugccugcagcuguacggccugggcgagacccacggcagcagcaacgagaccgagcacaacaagaccaacguggugaccacccccggcgacagccagagccccgagccccuggugagcaccacccugcccgugacccuggacagcagcaccgugacccccaccacccccgccagcgagcccgagggcagcggcgagguguacaccagcccccccaucaccaccgagggccugagccccagcgaggccaccagcgagcugcccgugaccaccggcaucggcaucagcagcgccagcgacguggacagcagcacccaggccgccggcgacaccagcacccccaccgugagaaccagcccccccaacagccccagcaccccccccaccagccaggacacccaccaccccaugagaaaccugcugagcgugaccagccugaagagcgaggagaccagcgcccccagcaagagcggcaaggagagccccgccgccagcagcccccaccccguggccagcagaccccccacccaccccaucaccgcccagggccccaccgagaacaacagccacaacaccaccggccagcuggagagcgugacccagagcgccacccugggccccauggccagccccacccagaccgugcugagccagaacgugaccagcaucgccauccaggacacccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccgagagccccaccgccgagcccuucaagagcuacuucgccaagggcuuccugagcaucgacagcggcuacuucagcgccaagugcuacagcagaaccagcgacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugagacugccccacauccaccacgagggcaccuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgaggugauccuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucagccacggcaagaccaucgagaccuaccaggccagagaggaguacaccagcaucugccuguucgugcugggcagcauccuguucaucgugagcugccugaugaagggccugguggacagcaucggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgccugcaagagaaugugcuucagagccaccauggaggugagcaacaaggcccugcugaucagaagcaucaucaacaccaccuucgugguguacauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugagaggcaugaagaacccccugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccagaggcaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8639 - RNA, 5070 nt, Artificial Sequence
  derived and/or modified CDS sequence (opt4) from CCHFV(75024)__AB069671.1__GP
augcccgugagcaucaugcacaucagccugaugugcgccgugcugugccugcagcuguacggccugggcgagacccacggcagcagcaacgagaccgagcacaacaagaccaacguggugaccacccccggcgacagccagagccccgagccccuggugagcaccacccugcccgugacccuggacagcagcaccgugacccccaccacccccgccagcggccccgagggcagcggcgagguguacaccagcccccccaucaccaccgagggccugagccccagcgaggccaccagcgagcugcccgccaccaccggcaucggcaucagcagcgccagcgacguggacagcagcacccaggccgccggcgacaccagcacccccaccgugagaaccagcccccccaacagcagcagcaccccccccaccagccaggacacccaccaccccaugagaaaccugcugagcgugaccagccugaagcccgaggagaccagcgcccccagcaagagcggcaaggagagccccgccgccagcagcccccaccccguggccagcagaccccccaccccccccaccaccgcccagggccccaucgagaacaacagccacaacaccaccggccagcuggagagcgugacccagagcgccacccugggccccauggccagccccacccagaccgugcugagccagaacgugaccagcaucgccauccaggacacccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccgagagccccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugagacugccccacauccaccacgagggcaccuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucggccacggcaagaccaucgagaccuaccaggccagagaggaguacaccagcaucugccuguucgugcugggcagcauccuguucaucgugagcugccugaugaagggccugguggacagcaucggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugagaggcaugaagaaccagcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaaccuguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8640 - RNA, 5070 nt, Artificial Sequence
  derived and/or modified CDS sequence (opt4) from CCHFV(66019)__AB069669.1__GP
augcccgccaacaucauguacacccugcuggugugcgccgugcugugcccccagcuguggagccuggagggcacccacgugccccacaacgagaccaagcacaacggcaccggcaucaccgccgcccccggcgagagccagggccccaugagccccgccagcaccgccgugccccugacccccgagccccccaacaccaagcccgccgccagcgccagcgagcuggagagcagcggcgagggccacaccagccugcuggccaccacccagggccugaccagccccgaggccacccccgagcugcccaccaccaccgacaccggcgugagcagcaccagcgugguggacaucggcacccagauggccaaggacacccccaccagcaccgcccacaccagccugcccagcaaccccagcgcccccagcaccgcccagggcacccaccacaccaucagaggccugcugagcgugaccagcaccaagcccgaggaggccagcacccccaccgaccccggcaaggccggcgccgagaccggcagccccagacccgccaucagcagaaagcccacccugagccccaccgccgaggcccccaccgagaucaacaacagcagcacccccaagcagcccgagcccagcauccagcccgccacccccagccuggugaucagccccgcccagcccgccuucccccagagcgccaccagcaccgccgcccaggacaucuacagcagccccaccaacagaagcaagagaaaccugaagauggagaucauccugacccugagccagggccugaagaaguacuacggcaagauccagaagacccugggccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaagacccccagcacccccggcagcaccgagcccacccacaccgaggcccccaccgugaagcccuucaagagcuacuucgccagaggcuuccugaccaucgacagcggcuacuucagcgccaagugcuacagcagaaccagcaacagcggccugcagcugaucaacgugacccagcaccccgccagaaucgccgacacccccggccccaagaucaccaaccugaagaccaucaacugcaucaaccugaaggccagcguguucaaggagcacagagagaucgagaucaacgugcugcugccccagguggccgugaaccugagcaacugccacgugcugaucaagagccacgugugcgacuacagccuggacaucgacggcaccaucagacugcccagaaucuaccacgagggcaccuucauccccggcaccuacaagaucgugaucgacaagagagacaagcagaacgacagaugcacccuggugaccaacugcgugaucaagggcagagaggugagaagaggccagagcgcccugagacaguacagaaccgagaucagaaucggcaaggccagcgccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaacacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgaggccuaccagaccagagagggcuacaccagcgugugccuguucaugcugggcggcauccuguucguggugagcugccugaugaagggccugguggacagcgugagcaacagcuucuuccccggccugagcaucugcaagaccugcagcaucggcagcgugaacggcuucgagaucgagagccacaagugcuacugcagccugcugugcugccuguacugcagacacugcagcgccgacagagagauccaccagcugcaccugagcaucugcaagaagagaagagccggcggcaacgugaugcuggccgugugcaagagaaugugccugagagccaccauggaggugagcaacaaggugcuguucaucagaagcaucaucaacaccaccuucgugaucugcauccuggugcuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcaacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8641 - RNA, 5070 nt, Artificial Sequence
  derived and/or modified CDS sequence (opt4) from CCHFV(BA8402)__AF350449.1__GP
augagcuucagcgugauguacaccccccugcugugcgccgugcugugccugcagcuguggagccuggagggcagccacggccugagcaacaagacccagcacagcaacaccagcaccaccaaggcccccgaggugagccaggagcugggccugcccgugagcaccgugagcaccaucaccagcgagccccccagcaucaccagcgccgugagcgugagcggcagcgagggcagcggcgacaccaacaccagccccagcgugaccacccagggccccacccugcccgagaccacccuggagccccugaccaccaccgacaccgacgccagcagcaccguggugguggacgugagcacccagaccgugaaggacacccccaucagcaccaccuacaccagccugcccagcacccccagcgagcccaccaccccccagggcacccaccacaccgccagaggccugcugagcgugaccagcaccaagcccgaggaggccagcccccaggccaaccccggcaagaucagcauggagaccaacggccccagacuggccaucagcgagacccccagcuucagccccaccacccaggcccccaccgagaacagcaaccccaucaccagcaagcagcugaugcugagcgcccagcccgugacccccaaccccaugaccagccccgugcagcccgcccugagccagagcgacaccagcaccgccauccaggacgugcaccccagccccaccggcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacaacuucuuccagaagagaaucgaggaguucuuccugaccggcaagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaagaucaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaacagcuucaaccugugcgagaacaccgccaccggcaagagcugcgagaucgacagcacccccgugaagugcagacagggcuucugccugaagaucacccaggagggcagaggccacgugaagcugagcagaggcagcgagguggugcuggacgccugcgagagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacccaccagcgacggccuggccagacacgugaugcagugccccaagagaaaggagaagaucgaggagaccgcccuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccugcacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8642 - RNA, 5070 nt, Artificial Sequence
  derived and/or modified CDS sequence (opt4) from CCHFV(BA66019)__AF350448.1__GP
augcccgccaacaucauguacacccugcuggugugcgccgugcugugcccccagcuguggagccuggagggcacccacgugccccacaacgagaccaagcacaacggcaccggcaucaccgccgcccccggcgagagccagggccccaugagccccgccagcaccgccgugccccugacccccgagccccccaacaccaagcccgccgccagcgccagcgagcuggagagcagcggcgagggccacaccagccugcuggccaccacccagggccugaccagccccgaggccacccccgagcugcccaccaccaccgacaccggcgugagcagcaccagcgugguggacaucggcacccagauggccaaggacacccccaccagcaccgcccacaccagccugcccagcaaccccagcgcccccagcaccgcccagggcacccaccacaccaucagaggccugcugagcgugaccagcaccaagcccgaggaggccagcacccccaccgaccccggcaaggccggcgccgagaccggcagccccagacccgccaucagcagaaagcccacccugagccccaccgccgaggcccccaccgagaucaacaacagcagcacccccaagcagcccgagcccagcauccagcccgccacccccagccuggugaucagccccgcccagcccgccuucccccagagcgccaccagcaccgccgcccaggacaucuacagcagccccaccaacagaagcaagagaaaccugaagauggagaucauccugacccugagccagggccugaagaaguacuacggcaagauccagaagacccugggccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaagacccccagcacccccggcagcaccgagcccacccacgccgaggcccccaccgugaagcccuucaagagcuacuucgccagaggcuuccugaccaucaacagcggcuacuucagcgccaagugcuacagcuggaccagcaacagcggccugcagcugaucaacgugacccagcaccccgccagaaucgccgacacccccggccccaagaucaccaaccugaagaccaucaacugcaucaaccugaaggccagcguguucaaggagcacagagagaucgagaucaacgugcugcugccccagguggccgugaaccugagcaacugccacgugcugaucaagagccacgugugcgacuacagccuggacaucgacggcaccaucagacugcccagaaucuaccacgagggcaccuucauccccggcaccuacaagaucgugaucgacaagagagacaagcagaacgacagaugcacccuggugaccaacugcgugaucaagggcagagaggugagaaagggccagagcgcccugagacaguacagaaccgagaucagaaucggcaaggccagcgccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaagcaccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgaggccuaccagaccagagagggcuacaccagcgugugccuguucaugcugggcggcauccuguucguggugagcugccugaugaagggccugguggacagcgugagcaacagcuucuuccccggccugagcaucugcaagaccugcagcaucggcagcgugaacggcuucgagaucgagagccacaagugcuacugcagccugcugugcugccuguacugcagacacugcagcgccgacagagagauccaccagcugcaccugagcaucugcaagaagagaagagccggcggcaacgugaugcuggccgugugcaagagaaugugccugagagccaccauggaggugagcaacaaggugcuguucaucagaagcaucaucaacaccaccuucgugaucugcauccuggugcuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8643 - RNA, 5070 nt, Artificial Sequence
  derived and/or modified CDS sequence (opt4) from CCHFV(BA88166)__AF338470.1__GP
augagcuucagcgugauguacaccccccugcugugcgccgugcugugccugcagcuguggagccuggagggcagccacggccugagcaacaagacccagcacagcaacaccagcaccaccaaggcccccgaggugagccaggagcugggccugcccgugagcaccgugagcaccaucaccagcgacccccccagcaucaccagcgccgugagcgugagcggcagcgagggcagcggcgacaccaacaccagccccagcgugaccacccagggccccacccugcccgagaccacccuggagccccugaccaccaccgacaccgacgccagcagcaccguggugguggacgugagcacccagaccgugaaggacacccccaucagcaccaccuacaccagccugcccagcacccccagcgagcccaccaccccccagggcacccaccacaccgccagaggccugcugagcgugaccagcaccaagcccgaggaggccagcacccaggccaaccccggcaagaucagcauggagaccaacagccccagacuggccaucagcgagacccccagcuucagccccaccacccaggcccccaccgagaacagcaaccccaucaccagcaagcagcugaugcugagcgcccagcccgugacccccaaccccaugaccagccccgugcagcccgcccugagccagagcgacaccagcaccgccauccaggacauccaccccagccccaccggcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacaacuucuuccagaagagaaucgaggaguucuuccugaccggcaagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaagaucaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaagggcaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccuggagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguaccuggacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaucaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8644 - RNA, 5070 nt, Artificial Sequence
  derived and/or modified CDS sequence (opt4) from CCHFV(UCCR4459)__KY484032.1__GP
augagcuucagcaucauguacaccccccugcugugcgccgugcugugccugcagcuguggagccuggagggcagccacggccugagcaacaagacccagcacagcaacaccagcaccaccaaggcccccgaggugagccaggaguucggccugcccgugagcaccgugagcaccaucaccagcgacccccccagcaucaccagcgccgugagcgugagcggcagcgagggcagcggcgacaccaacaccagccccagcgugaccacccagggccugacccugcccgagaccacccuggagcugcugaccaccaccgacaccgacgccagcagcaccguggugguggacgugagcacccagaccgugaaggacacccccaucagcaccacccacaccagccugcccagcacccccagcgccaccaccaccccccagggcacccaccacaccgccagaggccugcugagcgugaccagcaccaagcccgagggcgccagcacccaggccaaccccgagaagaucagcauggagaccaacagccccagacuggccaucagcgagacccccagcuucagccccaccacccaggcccccaccgagaacagcaaccccaucaccagcaagcagcugaucuucagcgcccagcccgugacccccaaccccgugaccccccccgugcagcccgcccugagccagagcgacaccagcaccgccauccaggacauccaccccagccccaccagcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacgacuucuuccagaagagaaucgaggaguucuuccugaccggcgagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaaggugaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagcuggugaucgacaagaagaacaagcagaacgacagaugcacccugaucaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8645 - RNA, 5070 nt, Artificial Sequence
  derived and/or modified CDS sequence (opt4) from CCHFV(K168_125)__KX013460.1__GP
augcccaucagcaccaugcacaucagccugaugugcgccgugcugugccugcagcuguacggccugggcggcacccacggccugcacaacggcaccgagcacaacaagaccaacgccgugaccaccagcagcaacagccagagcagcgagagccccgccagaaccgccccccccgugacccccgacagccccaccgugacccccaccacccccgccagcgcccccgagggcagcggcgaggcccacagcagcccccccaacaacaccgagggccccagccugcccgagagcaccagcgagccccccgccgccaccagcaccggcauccccagcgccagcgacgugaacagcagcacccaggccgccagagacaccagcacccccaccgugagaaccagcccccccaacagccccagcaccccccccaccccccaggagacccaccaccccgugagaaaccugcugagcgugaccagccacaagcccgaggagaccagcgcccccagcgagagcggcaaggagagccccgccgccaacagcccccaccccguggccagcagaccccccacccccagcaccaccgcccagggccccaccgagaacaacaacuacaacaccaccggccagcuggagagccugacccagagcaccacccugggccccaugaccagccugacccagaccgaccugccccagagcgugaccagcaucgccgugcaggacacccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccggccugcccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccugaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugagacugccccacauccaccacgacggcaccuucauccccggcaccuacaagaucgugaucgacagaaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaaggugccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccguggaggugagcaacaaggcccugagcaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaagaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8646 - RNA, 5070 nt, Artificial Sequence
  derived and/or modified CDS sequence (opt4) from CCHFV(K168_40)__KX013457.1__GP
augcccaucagcaccaugcacaucagccugaugugcgccgugcugugccugcagcuguacggccugggcggcacccacggccugcacaacggcaccgagcacaacaagaccaacgccgugaccaccagcagcaacagccagagcagcgagagccccgccagaaccgccccccccgugacccccgacagccccaccgugacccccaccacccccgccagcgcccccgagggcagcggcgaggcccacagcagcccccccaacaacaccgagggccccagccugcccgagagcaccagcgagccccccgccgccaccagcaccggcauccccagcgccagcgacgugaacagcagcacccaggccgccagagacaccagcacccccaccgugagaaccagcccccccaacagccccagcaccccccccaccccccaggagacccaccaccccgugagaaaccugcugagcgugaccagccacaagcccgaggagaccagcgcccccagcgagagcggcaaggagagccccgccgccaacagcccccaccccguggccagcagaccccccacccccagcaccaccgcccagggccccaccgagaacaacaacuacaacaccaccggccagcuggagagccugacccagagcaccacccugggccccaugaccagccugacccagaccgaccugccccagagcgugaccagcaucgccgugcaggacacccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccggccugcccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugagacugccccacauccaccacgacggcaccuucauccccggcaccuacaagaucgugaucgacagaaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccguggaggugagcaacaaggcccugagcaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacggcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8647 - RNA, 5070 nt, Artificial Sequence
  derived and/or modified CDS sequence (opt4) from CCHFV(K128_76)__KX013454.1__GP
augcccaucagcgugaugcacaucagccugaugugcgccgugcugugccugcagcuguacggccugggcggcacccacggcagccacaacgagaccgagcacaacaagaccaacgccgugaccaccagcagcgacagccagagccccgagccccccaccagaaccacccugcccgugacccccgacagccccaccgugacccccaccacccccgccagcgcccccgagggcagcggcgaggugcacaccagcccccccaacaccaccgagggccccagccugcccgagagcacccccgagccccccaccgccaccagcaccggcauccccagcgccagcgacgugaacagcagcacccaggccgccagagacaccagcacccccaccgugcacaccagcccccccaacagccccagcaccccccccacccugcaggagacccaccaccccaugagaaaccugcugagcgugaccagccacaagcccgaggagaccagcgcccccagcgagagcggcaaggagagccccgccgccaacagcccccaccccguggccgacagacccagcaccagcagcaccaccgcccagggccccaccgagaacaacagcuacaacaccaccgagcagcuggagagccugacccagagcaccacccugggccccaugaccagccugacccagaccgugcugagccagagcgugaccagcaucgccgugcaggacacccaccugagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccuggaccuggacugcgacgacaccuucuuccagaagagaaucgaggaguucuucaucaccggcgagggcuacuucaacgaggugcugcaguucagaacccccggcacccugagcaccaccgagagcacccacgccggccugcccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugaagcugccccacauccaccacgacggcaccuucauccccggcaccuacaagaucgugaucgacagaaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucagccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccaggacagcaucgugaagggcaugaagaaccugcugaacagcaccagccuggagaccagccugagcaucgaggcccccuggggcgccaucaacgugcagagcaccuacaagcccgccgugagcgccgccaacaucgcccugagcuggagcagcguggagcacagaggcagcaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggagaacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8648 - RNA, 5070 nt, Artificial Sequence
  derived and/or modified CDS sequence (opt4) from CCHFV(Hodzha)__KX013448.1__GP
augcccgugagcaucaugcacauccugcugaugugcgccgugcugugccugcagcaguacggccugggcgagacccacagacccaacaacggcaccgagcacaacaagaccaacgugcugaccacccccagcgacaagcugagccccgagccccccgugagcaccgcccugagcgugacccccgacagcagcaccgugacccccaccacccccgugagcggccuggagggcagcggcgagguguacaccagcccccccgugaccaccaagggccugagccccagcaaggccaccagcgagcugcccgccaccaccggcaucgacaccagcagcgccagcgacguggacagcagcacccaggccgccagagacaccagcacccugaccgugagaaccagcccccccagcagccccagcaccccccccaccagccaggacaccuaccaccuggugagaaaccugcugagcgugaccagccccagacccgaggagaccaccgcccccagcaagagcggcaaggagagccccguggccaacagcccccaccccgugaccagcagacccagcagcccccccaucaccgugcagggccccaccgagaacagcagccacaacaccaccggccagcuggagagcauggcccagagcaccacccuggugcccauggccagccccacccagaccgugcugagccagagcgugaccagccuggccgugcaggacgcccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucaagacccccagcacccugagcaccaccgagagcacccacgccgugagccccaccgccgagcccuucaagagcuacuucgccaagggcuuccugagcaucgacagcggcuacuucagcgccaagugcuacagcaagaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacguggacggcaccgugagacugccccacauccaccacggcggcaccuucauccccggcaccuacaagaucgugaucgacaagaagaacaagcugaacgacagaugcacccuguacaccaacugcgugaucaagggcagagaggugagaaagggccagagcauccugagacaguacaagaccgagaucagaaucggcaaggccagcaccggcagcagaagacugcugagcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccgagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggccagagaggaguacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugccccgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaagaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugcagcgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcagaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8649 - RNA, 5070 nt, Artificial Sequence
  derived and/or modified CDS sequence (opt4) from CCHFV(Hy13)__AY900145.1__GP
augagcuucagcaucauguacaccccccugcugugcgccgugcugugccugcagcuguggagccuggagggcagccacggccugagcaacaagacccagcacagcaacaccagcaccaccaaggcccccgaggugagccaggaguucggccugcccgugagcaccgugagcaccaucaccagcgacccccccagcaucaccagcgccgugagcgugagcggcagcgagggcagcggcgacaccaacaccagccccagcgugaccacccagggccugacccugcccgagaccacccuggagcugcugaccaccaccgacaccgacgccagcagcaccguggugguggacgugagcacccagaccgugaaggacacccccaucagcaccacccacaccagccugcccagcacccccagcgccaccaccaccccccagggcacccaccacaccgccagaggccugcugagcgugaccagcaccaagcccgagggcgccagcacccaggccaaccccgagaagaucagcauggagaccaacagccccagacuggccaucagcgagacccccagcuucagccccaccacccaggcccccaccgagaacagcaaccccaucaccagcaagcagcugaucuucagcgcccagcccgugacccccaaccccgugaccccccccgugcagcccgcccugagccagagcgacaccagcaccgccauccaggacauccaccccagccccaccagcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgccgacuucuuccagaagagaaucgaggaguucuuccugaccggcgagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaaggugaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagcuggugaucgacaagaagaacaagcagaacgacagaugcacccugaucaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggcagcagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggccaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8650 - RNA, 5070 nt, Artificial Sequence
  derived and/or modified CDS sequence (opt4) from CCHFV(SPU415/85)__DQ211635.1__GP
augcccgugaacaucauguacaccccccuggugugcgccgugaucugccugcagcuguggaaccugggcggcacccugguguucaucaacagaacccagcacaacgagaccggcaccguggccacccccgagggcacccugagacccagacugcccgugagcaccgcccugcccaccaagagcgacagacccagcgugggccccgccgccagcagcagcggccuggagggcagcggcgagcccaacaccagccccagcaucaccaccaagggccugaccccccccgagaccacccccgcccugcccaccgccaccgacaccgacgccagcagcaccggcgugguggacgugagcacccagaugaccaaggacauccccaugagcaccgccuacaccaacccccccagcacccccagcgcccccagcaccccccagggcacccaccacaccgccagaggccugcugagcguggccagcaccaagagcgaggaggugagcaugagcaccagccccgccaagaccagcaccgagaccagcagccccccccccgccaccagcgagacccccacccccagccccaccacccaggugcccaccggcaacaacaaccccaacaccagcagacagcccacccccagcgcccagcccgccaugagcaaccccgccaccagccccgcccagcccaaccugagccagagcgccccccccaccgccgaccagggcgugcaccccagccccaccaacagaagcaagagaaaccuggagaucgagaucauccugacccugagccagggccugagaaaguacuacggcaagauccugaagcugcuggaccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaaggugcccagcacccugagcagcaccgagcccacccacaccagaccccccaccguggagcccuucaagagcuacuucgccaagggcuuccugagcaugaacagcggcuacuucagcgccaagugcuaccccagaaccagcaacagcggccugcagcugaucaacgugaccaagcacagcgccaagaucgccgacacccccggccccaagaucaccaaccugaagaccaucaacugcaucaaccugagagccagcguguucaaggagcacagagagguggagaucaacgugcugcugccccagguggccgugaaccugagcaacugccacgcccagaucaagagccacgugugcgacuacagccuggccaccgacggcauggugagacugccccacauccaccacgagggcaccuucauccccggcaccuacaagaucgugaucgacaagaagaacaagcagaacgacagaugcacccuggugaccaacugcgugaucaagggcagagaggugagaaagggccagagcgcccugagacaguacaagaccgagaucagaaucggcaaggccagcagcggcagcagaagacugcugagcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucguggugagcugccuggugaagggccugaucgacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccaucgaggugagcaacagagcccugcugaucagaaacaucaucaacaccaccuucguggugugcauccugacccuggccgugugcguggugagcaccagcgccguggagauggagagccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggcuga

SEQ ID NO: 8651 - RNA, 5070 nt, Artificial Sequence
  derived and/or modified CDS sequence (opt4) from CCHFV(SPU97/85)__DQ211633.1__GP
augaccgugaacaccgugugcaccccccuggugugcgccguguucugccugcagcuguggaaccugggcggcacccuggugcccaccaacagaacccagcacaacaagaccggcaccauggccacccccgagggcacccugggccccagacugcccgugagcaccgcccugcccaccaagagcgacagacccagcgugggccccgccgcccccagcagcggccuggagggcagcggcgagcccaacaccagccccagcaucaccaccaagggccuggcccugcccgagaccacccccgccccccccaccgccaccgacaccgacgccagcagcaccggcguggugaacgugagcacccagaugaccaaggacauccccaugagcaccgccuacaccaacccccccagcacccccagcgcccccagcaccccccagggcacccaccacaccgccagaggccugcugagcguggccagcaccaagagcgaggaggugagcaugagcaccagccccggcaagaccagcaccgagaccagcagccccccccccgccaccagcgagacccccgcccccagccccaccacccaggcccccaccggcaacaacaaccccaacaccagcagacagcccacccccagcgcccagcccgccaugagcaaccccaccaccagccccgcccagcccaaccugcugcagaacgccccccccaccgccgaccagggcgugcaccccggccccaccaacagaagcaagagaaaccuggagauggagaucauccugacccugagccagggccugagaaaguacuacggcaagauccugaaguuccuggaccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaaggugcccagcacccugagcagcaccgagcccacccacaccggcagccccaccguggagcccuucaagagcuacuucgccaagggcuuccugagcaugaacagcggcuacuucagcgccaagugcuaccccagaaccagcaacagcggccugcagcugaucaacgugaccaagcacagcgccaagaucgccgacacccccggccccaagaucaccaaccugaagaccaucaacugcaucaaccugagagccagcguguucaaggagcacagagagguggagaucaacgugcugcugccccagguggccgugaaccugagcaacugccacgcccagaucaagagccacgugugcgacuacagccuggccaccgacggcauggugagacugcccagaauccaccacgagggcaccuucauccccggcaccuacaagaucgugaucgacaagaagaacaagcagaacgacagaugcacccuggugaccaacugcgugaucaagggcagagaggugagaaagggccagagcgcccugagacaguacaagaccgagaucagaaucggcaaggccagcagcggcagcagaagacugcugagcgaggagagcgacggcgacugcaucagcagaacccagcugcugagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcagcugcgagaucaugauccccaagggcaccggcgacauccugguggacugcagcggcggccagcagcacuuccugaaggacaaccugaucgaccugggcugccccaacaucccccugcugggcagaauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucaucgugagcugccuggugaagggccugaucgacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccaucgaggugagcaacagagcccugcugaucagaagcaucaucaacaccaccuucgccgugugcauccugacccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacacccagaagugcgugaacaccaagcuggagagaccccagagcauccugaucgagcacaagggcaccaucaucggcaagcagaacgacaccugcaccgccaaggccagcugcuggcuggagagcgugaagagcuucuucuacggccugaagagcaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggcuga

SEQ ID NO: 8652 - RNA, 5070 nt, Artificial Sequence
  derived and/or modified CDS sequence (opt4) from CCHFV(C-68031)__DQ211629.1__GP
augagcuucagcaucauguacaccccccugcugugcgccgugcugugccugcagcuguggagccuggagggcagccacggccugagcaacaagacccagcacagcaacaccagcaccaccaaggcccccgaggugagccaggaguucggccugcccgugagcaccgugagcaccaucaccagcgacccccccagcaucaccagcgccgugagcgugagcggcagcgagggcagcggcgacaccaacaccagccccagcgugaccacccagggccugacccugcccgagaccacccuggagcugcugaccaccaccgacaccgacgccagcagcaccguggugguggacgugagcacccagaccgugaaggacacccccaucagcaccacccacaccagccugcccagcacccccagcgcccccaccaccccccagggcacccaccacaccgccagaggccugcugagcgugaccagcaccaagcccgagggcgccagcacccaggccaaccccgagaagaucagcauggagaccaacagccccagacuggccaucagcgagacccccagcuucagccccaccacccaggcccccaccgagaacagcaaccccaucaccagcaagcagcugauccugagcgcccagcccgugacccccaaccccgugaccccccccgugcagcccgcccugagccagagcgacaccagcaccgccauccaggacauccaccccagccccaccagcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacgacuucuuccagaagagaaucgaggaguucuuccugaccggcgagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaaggugaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagcuggugaucgacaagaagaacaagcagaacgacagaugcacccugaucaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcaucaacggcuucgagaccgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8653 - RNA, 5070 nt, Artificial Sequence
  derived and/or modified CDS sequence (opt4) from CCHFV(Baghdad 12)__AJ538197.2__GP
augcccgugagcaucaugcacaucagccugaucuacgccgugcugugccugcagcuguacggccugggcgagacccacggcagcagcagcggcaccgagcacaacagaaccaacgugguggccacccccggcggcagccagagccccgagccccuggugagcaccacccugcccgugacccuggacagcagcaccgugacccccgccacccaggccagcggccccgagggcagcggcgagguguacaccagcccccccaccaccaccgagggccugagccccagcgacgccaccagcgagcugcccaccaccaccggcaucggcaucagcagcagcagcgacgugaacagcagcacccaggccgccggcgacaccagcacccccaccgccagaaccagccugcccgacagccccagcaccccccccaccagccaggacacccaccaccccaugagaaaccugcugagcgugaccagccugaagcccgaggagacccccgcccccagcaagagcggcaaggagagccccgccgccagcagcccccaccccguggccagcagaccccccacccccagcaccaccgcccagggccccaccgagaacaacagcagaaacaccaccgugcagcugaagagcgugacccagagcgccacccugggccccauggccagccccacccagaccgugcugcugcagagcgugaccagcaucgccauccaggacacccaccccagccccaccaacagaagcagaagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccggcagccccaccguggagcccuucaagagcuacuucgccaagggcuuccugcugaucgacagcggcuacuucagcgccaagugcuacagcagaaccagcaacagcggccugcagcugaucaacgugaccagacacagcaccaagaucgccgacacccccggccccaagaucaccaaccugaagaccaucagcugcaucaaccugaaggccagcaucuucaaggagcacagagagaucgagaucaacgugcugcugccccagguggccgugaaccugagcaacugccacgugaccaucaagagccacgugugcgacuacagccugaacaucgacggcaccgugaagcugccccacauccaccacgagggcaucuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgaggagagcggcgacgacugcaucagcagaaccagacugcugagaaccgagaccgccgagauccacggcgacagcuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcaagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcuggccgugagcagcagccccgugcagagcgcccccaucggcuacggcaagaccaucgagaccuaccaggccagagagggcuacaccagcaucugccuguucgugcugggcagcauccuguucaucgugagcugccugaccaagggccugguggacagcaucggcaacaucuucuuccccggccugagcaucugcaagaccugcagcaucggcagcaucaacggcuucgagguggagagccacaagugcuacugcagccugcugugcugccccuacugcagacacugcagcgccgacagagagauccaccagcugcaccugagcaucugcaagaagagaaagaccggcagcagcgugaugcuggccgugugcaagagaaugugcuucagagccaccauggaggugagcaacaaggcccugcugaucagaagcaucaucaacaccaccuucguggugugcauccugacccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgacgccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggugagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8654 - RNA, 5070 nt, Artificial Sequence
  derived and/or modified CDS sequence (opt4) from CCHFV(Hodzha)__AY223476.1__GP
augcccgugagcaucaugcacauccugcugaugugcgccgugcugugccugcagcaguacggccugggcgagacccacagacccaacaacggcaccgagcacaacaagaccaacgugcugaccacccccggcgacaagcugagccccgagcugcccgugagcaccgcccugagcgugacccccgacagcagcaccgugacccccaccacccccgugagcggccuggagggcagcggcgacguguacaccagcccccccgugaccaccaagggccugagccccagcaaggccaccagcgagcugcccgccagcagcggcaucgacaccagcagcgccagcgacguggacagcagcacccaggccgccagagacaccagcacccugaccgugagaaccagcccccccagcagccccagcaccccccccaccagccaggacaccuaccaccuggugagaaaccugcugagcgugaccagccccuggcccgaggagaccaccgcccccagcaagagcggcaaggagagccccguggccaacagcccccaccccgugaccagcagacccagcagcccccccaucaccgugcagggccccaccgagaacagcagccacaacaccaccggccagcuggagagcauggcccagagcaccacccuggugcccauggccagccccacccagaccgugcugagccagagcgugaccagccuggccgugcaggacgcccaccccagccccaccaacagaagcaagagaaaccuggagauggugaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucaagacccccagcacccugagcaccaccgagagcacccacgccgugagccccaccgccgagcccuucaagagcuacuucgccaagggcuuccugagcaucgacagcggcuacuucagcgccaagugcuacagcaagaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacguggacggcaccgugagacugccccacauccaccacggcggcaccuucauccccggcaccuacaagaucgugaucgacaagaagaacaagcugaacgacagaugcacccuguacaccaacugcgugaucaagggcagagaggugagaaagggccagagcauccugagacaguacaagaccgagaucagaaucggcaaggccagcaccggcagcagaagacugcugagcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcaagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggccagagaggacuacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagagaaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8655 - RNA, 5067 nt, Artificial Sequence
  derived and/or modified CDS sequence (opt4) from CCHFV(Kosovo/9553/2001)__AY675511.1__GP
augcccaucaacaucaugcacacccugcuggugugcuucauccuguaccugcagcugcugggccugggcggcgcccacggccagagcaacgccaccgagcacaacggcaccaacaccaccaccgcccccggcaccagccagagccccaagccccccgccagcaccacccccagccacgcccccgagagcagcaccaucaagcugaccacccccaccagcgagaccgagggcagcggcgagaccaccccccccaccagcaccacccagggcagccccccccuggagaccacccccgagagaagcaccaccaccgccaccagcaccagcggcaccgacaacaugaacagcaccacccagaugaccgacaacacccccacccugaccgccagcaccagccccagcagcagccccagcacccccagcaccagccagggccugcacuaccccgugagaagccugcugagcgugagcagccccaagaccgugaccacccccacccccaugagccccggcgagaugagcagcgagaccagcagccagcacagcgccaugagcagaacccccaccccccacaccgccacccaggugagcaccgagaacgccaacagaagcaccagcagacagagcgagagcagcgcccagcccgccacccagagccccgugaccagccccgcccagagcauccugcugaugagcgccacccccaccaccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccccagccccaccgagcccagccacgccagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaucaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucaugcccggcaccuacaagaucgugaucgacagaaagaacaagcugaacgacagaugcacccuggugaccaacugcgugaucaagggcagagaggugagaaagggccagagcgugcugagacaguacaagaccgagaucaagaucggcaaggcccccaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucgccagaaugagcaaccaccccaagaccaccauggccuuccuguucugguucagccugggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggccagcaccagcgccguggagauggagacccugcccgccgccaccugggagagagaggaggaccugaccaacuucugccaccaggagugccaggugcccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcccaacgacaccugccccgccaagaccagcugcuggcuggagagcgugaagagcuucuucuacggccugaagaacaugcugggcagcguguucggcaacuucuucaucggcauccugcuguuccuggcccccuucuuccuguggaugcugagcuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8656 - RNA, 5067 nt, Artificial Sequence
  derived and/or modified CDS sequence (opt4) from CCHFV(200406546-Turkey)__KR864902.1__GP
augcccaccaacaucacccacacccugcuggugugcuucauccuguaccugcagcugcugggcagaggcggcgcccacggccagagcaacgccaccgagcacaacggcaccaacaccaccaccgcccccggcaccagccagagccacaagccccuggugagcaccacccccccccacacccuggagagcagcaccaucaagcacaccacccccaccagcgagaccgagggcagcggcgagaccacccccccccccaacaccacccagggccccagcccccccgaggccacccccgagagacccgccaccaccgccaccagcacccccagcaccgacaacaccaacagcaccacccagaugaacgacaacaaccccaccagcaccaucagcaccagccccagcagcagccccagcaccccccccaccccccagggcauccaccaccccgccagaagccugcugagcgugagcagccugaagaccgccaccacccccacccccaccagccccggcgagaucagcagcgagaccagcagccagcacagcgccaugagcagaacccccacccugcacaccaccacccaggugagcaccgagagcaccaaccacagcacccccagacagagcgagagcagcgcccagcccaccacccccagccccaugaccagccccgcccagagcauccugcccaugagcgccgcccccaccgccauccagaacauccaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcagcugcgacgacgacuucuuccagaagagaaucgaggaguucuucgugaccggcgagggcuacuucaacgaggugcugcaguucaagacccugagcacccugagccccaccgagcccagccacgccaagcugcccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacgccgugaucaagagccacgugugcgacuacagccuggacaccgacggccccgugagacugccccacaucuaccacgagggcaccuucauccccggcaccuacaagaucgugaucgacaagaagaacaagcugaacgacagaugcauccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugaucgaccugggcugcccccacgugccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaaguucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugaccgccagaaagcuggaguucggcaccgacagcaccuucaaggccuucagcgccaugcccaagaccagccugugcuucuacaucguggagaaggaguacugcaagagcugcaacgaggacgacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacaagagaaucaucgagagacugaacaacaagaagggcaagaacagacugcuggacggcgagagacuggccgacagaaagaucgccgagcuguucagcaccaagacccacaucggcuga

SEQ ID NO: 8657 - RNA, 5067 nt, Artificial Sequence
  derived and/or modified CDS sequence (opt4) from CCHFV(Haskovo-V46/13)__KR092379.1__GP
augcccaccaacaucaugcacacccugcuggugugcuucauccuguaccugcagcugcugggccugggcggcgcccacggccagagcaacaccaccgagcacaacggcaccaacaacaccaccgcccccggcaccagccagagccccaagccccacaugagcaccacccccccccacgcccccgagagcagcaccaucaagcccaccacccccaccagcgagaccgagggcagcggcgagaccaccccccccagcaacaccacccagggccccagcccccccgagaccaccagcgagagacccgccaccaccgccaucagcaccagcagcaccgacaacaugaaccccaccagccagaugaccgacaacacccccaccagcaccgugagcaucagccccagcagcagccccagcacccccagcaccccccagggcaugcaccaccccgccagaagccugcugagcgugagcagccccaagaccgccaccacccccacccccaccagccccguggaggugggcagcgagaccagcagccagcacagcgccaugagcagcacccccaccccccacaccgccacccaggugagcaccgagaacaccaaccacagcacccccagacagagcgagcccagcgcccagcagaccacccccagccccaugcccagccccgcccagagcacccugcugaugagcgccgcccccaccgccgugcagaacacccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccauggagcccagccacgccgagcugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaaggccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcugggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagaggcaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugcccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugggcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgccaugugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccaagcuggagcagccccagagcauccugaucgagcacaagggcaccaucaucggcaagcagaacgacaccugcaccgccagagccagcugcuggcuggagagcgugaagagcuucuucuacggccugaagaacaugcugggcagcguguucggcaacuuccugaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8658 - RNA, 5067 nt, Artificial Sequence
  derived and/or modified CDS sequence (opt4) from CCHFV(VLG/TI29414)__AY179961.1__GP
augcccaccaacaucaugcacacccugcuggugugcuucauccuguaccugcagcugcugggccugggcggcgcccacauccagagcaacgccaccgagcacaacggcaccaacaccaccaccgcccccagcaccagccagagccccaagccccuggugagcaccgcccccccccacgcccuggagagcagcaccaucaagcccaccacccccgugagcgagaccgagggcagcggcggcaccacccccccccccaacaccacccagggccccagcccccccgaggccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaaccagcacccuguacaccgccacccaggugagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaagccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagagccgagcccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaacgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcugggaggugggcaccggcugcaccugcugcggcuggaacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcaugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugaucgccgccagcaccagccugauggccagaaagcuggaguucggcaccgacagcaccuucaaggccuucagcgccaugcccaagaccagccugugcuucuacaucgccgagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8659 - RNA, 5067 nt, Artificial Sequence
  derived and/or modified CDS sequence (opt4) from CCHFV(UCCR4405)__KY484029.1__GP
augcccaucaacaucaugcacgcccugcuggugugcuucauccuguaccugcagcugagcggccugggcggcgcccacagacagagcaacgccaccgagcacaacggcaccaacaccaccaccgcccccggcaccagccagagccccaagccccccgugagcaccacccugccccacacccccgaggccagcaccaucaagcugaccacccccaccagcgagaccgagggcagcggcgagaccacccccccccccaacaccacccagggccugccccugcccggcaccacccccgagagaagcgccaccaccgccaccagcaccagcagcaccgacgacaugaacagcaccacccagaugaccgacaacacccccaccagcaccgugagcaucggccugagcagcagccccagcaugcccagcaccagccagggcauccacuaccccgugagaagccugcugagcgugagcagccccaagaccgccaccacccccacccccaugagccccggcgaggugagccccgagaccagcagccagcacagcgccaugagcagaauccccacccuguacaccgccacccaggugagcaccgagaacaccaacagaagcauccccagacagagcgagagcagcgugcagcccgccacccagagccccaucaccagccccgcccagaccauccugcugaugagcgccgcccccaccgccauccaggacaugcaccccagccccaagaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccccagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcgccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacuacagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugauccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8660 - RNA, 5067 nt, Artificial Sequence
  derived and/or modified CDS sequence (opt4) from CCHFV(Ast133)__KX056060.1__GP
augcccaucaacaucaagcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccccccccacacccccgagagcagcaccgugaagcugaccacccccaccagcgagaccgagggcagcggcgagaccacccccccccccaacaccacccagggccugccccugcccggcaccacccccgagagaagcgccaccaccgccaccagcaccagcagcaccgacaacaugaacagcaccacccaggugaccgacaacacccccaccagcaccgugagcaucagccccagcagcagccccagcaugcccagcaccagccagggcauccaccaccccgugagaagccugcugagcgugagcagccccaagaccgugaccacccccacccccaugagccccggcgagaugagccccgagaccagcagccagcacuucgccaugagcagaauccccacccuguacaccgccacccaggugagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccgacgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcagcaagacccacaucggcuga

SEQ ID NO: 8661 - RNA, 5067 nt, Artificial Sequence
  derived and/or modified CDS sequence (opt4) from CCHFV(Ast137)__KX056057.1__GP
augcccaucaacaucaugcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaccagcagcaccgacaacaugaacagcaccacccaggugaccgacaacacccccaccagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccgcccaggugagcaccgagaacaccaacagaagcacccccagacagagcgagagcagcgcccagcccgccacccagagccccaccaccuuccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccauccacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcuaccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggcuga

SEQ ID NO: 8662 - RNA, 5067 nt, Artificial Sequence
  derived and/or modified CDS sequence (opt4) from CCHFV(Ast149)__KX056054.1__GP
augcccaucaacaucaugcacacccugcuggugugcuucauccuguaccugcagcugagcggccugggcggcgcccacggccagagcaacgccaccgagcacaacggcaccaacaccaccaccgcccccggcaccagccagagccccaagccccccgccagcaccacccccccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaccagcagcaccgacaacaugaacagcaccacccaggugaccgacaacacccccaccagcaccgugagcaccagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccgcccaggugagcaccgagaacgccaacagaagcacccccagacagagcgagagcagcgcccagcccgccacccagagccccaccaccuuccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucuacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcccaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggcccuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggcuga

SEQ ID NO: 8663 - RNA, 5067 nt, Artificial Sequence
  derived and/or modified CDS sequence (opt4) from CCHFV(Ast199)__KX056051.1__GP
augcccaucaacaucaugcacacccugcuggugugcuucauccuguaccugcagcugagcggccugggcggcgcccacgugcagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccaccaccagcagcaccgacaacaugaacagcaccacccaggugaccgacaacacccccaccagcaccgugagcaucagccccagcagcaaccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccgcccaggugagcaccgagaacaccaacagaagcacccccagacagagcgagagcagcgcccagcccgccacccagagccccaccaccuuccccgcccagaccaucccccugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccccagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaugcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggcuga

SEQ ID NO: 8664 - RNA, 5067 nt, Artificial Sequence
  derived and/or modified CDS sequence (opt4) from CCHFV(Saf)__KX013487.1__GP
augcccaccaacaucaugcacacccugcuggugugcuucauccuguaccugcagcugcugggccugggcggcgcccacggccagagcaacgccaccgagcacaacggcaccaacaccaccaccgcccccagcaccagccagagccccaagccccuggugagcaccgcccccccccacgcccuggagagcagcaccaucaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacauccaccacgagggcaccuucauccccggcaccuacaagaucgugaucgacaaggagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuaccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaugaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgugagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8665 - RNA, 5067 nt, Artificial Sequence
  derived and/or modified CDS sequence (opt4) from CCHFV(Min)__KX013481.1__GP
augcccaccaacaucaugcacacccugcuggugugcuucauccuguaccugcagcugcugggccugggcggcgcccacggccagagcaacgccaccgagcacaacggcaccaacaccaccaccgcccccagcaccagccagagccccaagccccuggugagcaccgcccccccccacgcccuggagagcagcaccaucaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccugaagaccgccaccacccccacccccaccagccccggcgagaucagcagcgagaccagcagccugcacagcgccaugagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaucgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcaccaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8666 - RNA, 5067 nt, Artificial Sequence
  derived and/or modified CDS sequence (opt4) from CCHFV(Mamon)__KX013478.1__GP
augcccaccaacaucaugcacacccugcuggugugcuucauccuguaccugcagcugcugggccugggcggcgcccacggccagagcaacaccaccgagcacaacggcaccaacaccaccaccgcccccagcaccagccagagccccaagccccuggugagcaccgcccccccccacgcccuggagagcagcaccaucaagcccaccacccccgccagcgagaccgagggcagcggcgagaccacccccccccccaacaucacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgagaucagcagcaagaccagcagccugcacagcgccaugagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugagcgacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccguggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaagaccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8667 - RNA, 5067 nt, Artificial Sequence
  derived and/or modified CDS sequence (opt4) from CCHFV(K340_6)__KX013475.1__GP
augcccaucaacaucaugcacacccugcuggugugcuucauccuguaccugcagcugagcggccugggcggcgcccacgugcagagcaacgccaccgagcacaacggcaccaacaccaccaccgcccccggcaccagccagagccccaagccccccgccagcaccacccugccccacacccccgagagcagcaccgugaagcccaccacccccaccagcgagaccgagggcagcggcgagaccacccccccccccaacaccacccagggccugccccccaccggcaccacccccgagagaagcgccaccaccgccaccagcaccagcagcaccgacaacaugaacagcaccacccaggugaccgacagcacccccaccagcaccgugagcaccagccccagcagcagcagcagcaugcccagcaccagccagggcauccaccaccccgugagaagccugcugagcgugagcagccccaagaccgugaccacccccacccccaugagccccggcgagaugagccccgagaccagcagccagcacagcgccaugagcagagugcccacccuguacaccgccacccaggugagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcaccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacauccccccccugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccugagccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggaggugaccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacacuucaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8668 - RNA, 5067 nt, Artificial Sequence
  derived and/or modified CDS sequence (opt4) from CCHFV(K323_27)__KX013472.1__GP
augcccaucaacaucaugcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugccccugcccggcaccacccccgagagaagcgccaccaccgccaccagcaccagcagcaccgacaacaugaacagcaccacccaggugaccgacaacacccccaccagcaccgugagcaucagccccagcagcagccccagcaugcccagcaccagccagggcauccaccaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagagcagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucagcagccacgugugcgacuacagccuggacaccgacggccccgugagacugcccagaauccaccacgagggcaccuucauccccggcaccuacaagaucgugaucgacagaaaggacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaccgugcugcuggugcugcugaccgugagccugagccccgugcagagcgcccccgugggccacggcaacaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugcccccacugcagacacagaagcgccgacagagagauccaccagcugcaccugagcaucugcaagaagagaaagaccggcagcaacgugaugcuggccgugugcaagagaaugugccccaaggccaccaucgaggccagcagaagagcccugcccaucagaagcaucaucaacaccacccuggugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccggccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaacgacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8669 - RNA, 5067 nt, Artificial Sequence
  derived and/or modified CDS sequence (opt4) from CCHFV(K315_14)__KX013469.1__GP
augcccuucaacaucaugcacacccugcuggugugcuucauccuguaccugcagcugagcggccugggcggcgcccacggccagagcaacgagaccgagcacaacggcaccaacaccaccaccgugcccggcaccagccagagccccaagccccccgccagcaccacccugcagcacacccccgagagcagcaccgugaagcugaccacccccaccagcgagaccgagggcagcggcgagaccacccccccccccaacaccacccagggccugcccccccccggcaccacccccgagagaagcgccaccaccgccaccagcaccagcagcaccgacaacaugaacagcaccacccaggugaccgacaacacccccaccagcaccgugagcaucagccccagcagcagccccagcaugcccagcaccagccagggcauccacuaccccaucagaagccugcugagcgugagcagccccaagaccgugaccacccccacccccaucagccccggcgagaugagccccgagaccagcagccagcacagcgccaugagcagaauccccacccuguacaccgccacccaggugagcaccgagaacaccaacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucagaaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguguacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaagcugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8670 - RNA, 5067 nt, Artificial Sequence
  derived and/or modified CDS sequence (opt4) from CCHFV(K229_243)__KX013466.1__GP
augcccaccaacaucaugcacacccugcuggugugcuucauccuguaccugcagcugcugggccugggcggcgcccagggccagagcaacgccaccgagcacaacgagaccaacaccaccaccgcccccagcaccagccagagccccaagccccccgugagcaccacccccccccacgcccuggagagcagcaccaucaagcccaccacccccgccagagagaccgagggcagcggcgagaccacccccccccccaacaccacccagggccccagcccccccgaggccacccccgagagacccgccaccaccgccaccagcacccccagcaccgacaacaccaacagcaccacccacgugaccgacaacaaccccaccagcaccaucagcaccagccccagcagcagccccagcacccccuucaccccccagggcauccaccaccccgccagaaaccugcugagcgugagcagccccaagaccgccaccacccccacccccaccagccccagagagcugagcagcgagaccagcagccugcacagcgccaucagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccgccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccugacccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8671 - RNA, 5067 nt, Artificial Sequence
  derived and/or modified CDS sequence (opt4) from CCHFV(K229_194)__KX013463.1__GP
augcccaucaacaucaugcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaccagcagcaccgacaacaugaacagcaccacccaggugaccgacaacacccccaucagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaccaacagaagcacccccagacagagcgagagcagcgcccagcccgccacccagagccccaccaccagccccacccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugaacacccugagccccaccgagcccagccacgugagacugcccaccgccgagcccuucaagagcuacuucgccaagggcuuccugagcguggacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaagggcaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccagcuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacagcugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggcuga

SEQ ID NO: 8672 - RNA, 5067 nt, Artificial Sequence
  derived and/or modified CDS sequence (opt4) from CCHFV(Gaib)__KX013445.1__GP
augcccgugagcaucauguacaucccccugguguacgccgugaucuaccugcagcuguacggccugggcggcgcccacggccugcugaacaagaccgagcagaacgagaccggcaucaccgccacccacggcagagugcagggcccccccagcgccagcaucacccugcccgugacccccgacccccugagcgccaccagcgccgccagcaccagcggccccgagggcagcggcgaggugcccaccagccccagcaccaucacccagggccugaccagcagcgagaacaccccccagcugcccaccgccaccgacaccggcaucagcagcaccagcaucaucgacgugagcacccagaccgccggcgacaccagcacccccaccgcccacaccagccugcccaacagccccagcgcccccuucaccagccaggacaccagacacaccgugagaggccugcugaccgugaccagcaccaagagcgacgaggccagcacccugaccgaccccaaggaggccagcaccgaggccagaagccccagccccagcaucagcagaacccccacccccagccccaccgugcaggccagcaccgagaacaacacccccagcacccccagacagcccgagcccaccaccagacccgcccugcccagccccaccaccagccccacccagcccagccugagccagagcgccaccagcgccgccauccaggacaugcaccccagccccaccaacagaagcagaagaaaccuggagauggagaucauccugacccugagccagggccugaagaaguacuacggcaagauccugaagcugcuggaccugacccuggaggaggacaccgagggccugcuggaguggugcaagagaaaccuggaccugaccugcgacgagaacuucuuccugaagagaaucgaggaguucuuccugagcggcgagggccacuucaacgaggugcugcaguucaaggcccccagcaccaugagcagcaccgagcccacccacgccggcccccccaccguggagcccuucaagagcuacuucgccaagggcuuccugagcaucgacagcggcuacuucagcgccaagugcuaccccagaaccagcaacagcggccugcagcugaucaacgugacccagcacaccgccagaaucgccgacacccccggccccaagaucaccaacgugaagaccaucaacugcaucaaccugaaggccagcguguucaagaagcacagagagguggagaucaacgugcugcugccccagaucgccgugaaccugagcaacugccacgugcugaucaagagccacgugugcgacuacagccugaacuucgacggcauggugagacugcccagaauccaccacgagggcaccuucauccccggcaccuacaagaucgugaucgacagaaagaacaagcagaacgacagaugcacccuggugaccaacugcgugaucaagggcagagaggugagaaagggccagagcgcccugagacaguacagaaccgagaucaagaucggcgaggccagcaucggcagcagaagacugcugagcgaggagagcagcgacgacugcaucagcagaacccagcugcugagaaccgagaccgccgagauccacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggccaucuucuaccugcugaucaucgugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacguggugcacugccccaagagaaaggagaagaucgaggagaccgagcuguaccugaaccuggagagagugcccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcggcauccuguucaucgugagcugccugaugaagggccugguggacagcgugggcaacaacuucuuccccggccugaccaucugcaagaccugcagcaucagcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugccugagagugaccaccgaggugagcaacagagcccuguucaucagaagcaucaucaacaccaccuucgugaucugcauccugauccuggccgugugcgugaucagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugagcggcagaagcgagagcaucaugaagcuggaggagagaaccggcaucagcugggaccugggcguggaggacgccagcgagagcagacugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcagagaggacacccagaagugcgugagcaccaagcuggagcagccccagagcauccugaucgagcacaagggcaccaucaucggcaagcagaacaacaccugcaccaccaagaccaccugcuggcuggagagcgugaagagcuucuucuacggccugaagaacaugcugagcagcaucuucggcaacguguucgugggcaucuucagcuuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagagcaagcugcuggacggcgagagacuggccgacagaaagaucgccgagcuguucagcaccaagacccacaucggcuga

SEQ ID NO: 8673 - RNA, 5067 nt, Artificial Sequence
  derived and/or modified CDS sequence (opt4) from CCHFV(Kosova Hoti)__EU037902.1__GP
augcccaucaacaucaugcacacccugcuggugugcuucauccuguaccugcagcugcugggccugggcggcgcccacggccagagcaacgccaccgagcacaacggcaccaacaccaccaccgcccccggcaccagccagagccccaagccccccgccagcaccacccccagccacgcccccgagcccagcaccaucaagcugaccacccccaccagcgagaccgagggcagcggcgagaccaccccccccaccaacaccacccaggacagccccccccuggagaccacccccgagagaagcgccaccaccgccaccagcaccagcggcaccgacaacaugaacagcaccacccagaugaccgacaacacccccaccagcaccgugagcaccagccugagcagcagccccagcacccccagcaccagccagggcaugcaccaccccgugagaagccugcugagcgugagcagccccaagaccgccaccacccccacccccaugagccccggcgagaugagcagcgagaccagcagccagcacagcgccaugagcagaacccccaccccccacaccgccacccaggugagcaccgagaacgccaacagaagcaccagcagacagagcgagagcagcgcccagcccgccacccagagccccgugaccagccccgcccagagcauccugcugaugagcgccacccccaccaccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccccagcagcaccgagcccagccacgccagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucaugcccggcaccuacaagaucgugaucgacagaaagaacaagcugaacgacagaugcacccuggugaccaacugcgugaucaagggcagagaggugagaaagggccagagcgugcugagacaguacaagaccgagaucaagaucggcaaggcccccaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccagaagggcagaggccacgugaagcugagcagaggcagcgagguggugcuggacgccugcgacagcaacugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccaagaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugaacaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugcccccagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8674 - RNA, 5067 nt, Artificial Sequence
  derived and/or modified CDS sequence (opt4) from CCHFV(Turkey200310849)__DQ211636.1__GP
augcccaccaacaucaugcacacccugcuggugugcuucauccuguaccugcagcugcugugccugggcggcgcccacggccagcugaacaccaccgagcacaacggcaccaacaacaccaccgcccccggcgccagccagagccccaagccccccaugagcaccacccccccccacgcccccgagagcagcaccaucaagcccaccacccccaucagcgaggccgagggcagcggcgagaccaccagcacccccaacaccacccagggccugagcagccccgagaccaccagcgagagacccgccaccaccgccaucagcaccagcagcaccgacagcaccaaccccaccacccagaugaccgacaacacccccacccugaccgugagcaccagccccagcagcagccccagcacccccagcaccccccagggcaucuaccaccccgccagaagccugcugagcgugagcagccccaagaccgugaccacccccacccccaccagccccggcgagaugagcagcgagaccagcagccagcacagcgccaugagcagaauccccaccccccacaccgccaccagagugagcaccgagaacaccaaccacagcacccccagacagagcgagagcagcgcccagcagaccacccccagccccaugaccagccccgcccagagcauccugcugaugagcgccgcccccaccgccgugcaggacauccaccccagccccaccaacagaagcaagagaaaccuggagaccgagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagacugcccaccgccgagcccuucaagagcuacuucgccaagggcuuccugagcaucgacagcggcuacuucagcgccaagugcuaccccagaagcagcgccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcuucagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucagcugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgacagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccgccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggcuga

SEQ ID NO: 8675 - RNA, 5067 nt, Artificial Sequence
  derived and/or modified CDS sequence (opt4) from CCHFV(Kashmanov)__DQ211631.1__GP
augcccaccaacaucaugcacacccugcuggugugcuucauccuguaccugcagcugcugggccugggcggcgcccacggccagagcaacgccaccgagcacaacggcaccaacaccaccaccgcccccagcaccagccagagccccaagccccuggugagcaccgcccccccccacgcccuggagagcagcaccaucaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgagaucagcagcgaggccagcagccugcacagcgccaugagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaucgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccggcccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcaccaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaacagccugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8676 - RNA, 5067 nt, Artificial Sequence
  derived and/or modified CDS sequence (opt4) from CCHFV(Drosdov)__DQ211630.1__GP
augcccaucaacaucaugcacgcccugcuggugugcuucauccuguaccugcagcugagcggccugggcggcgcccacagacagagcaacgccaccgagcacaacggcaccaacaccaccaccgcccccggcaccagccagagccccaagccccccgugagcaccacccugccccacacccccgaggccagcaccaucaagcugaccacccccaccagcgagaccgagggcagcggcgagaccacccccccccccaacaccacccagggccugccccugcccggcaccacccccgagagaagcgccaccaccgccaccagcaccagcagcaccgacgacaugaacagcaccacccagaugaccgacaacacccccaccagcaccgugagcaucggccugagcagcagccccagcaugcccagcaccagccagggcauccacuaccccgugagaagccugcugagcgugagcagccccaagaccgccaccacccccacccccaugagccccggcgaggugagccccgagaccagcagccagcacagcgccaugagcagaauccccacccuguacaccgccacccaggugagcaccgagaacaccaacagaagcauccccagacagagcgagagcagcgugcagcccgccacccagagccccaucaccagccccgcccagaccauccugcugaugagcgccgcccccaccgccauccaggacaugcaccccagccccaagaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccccagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcgccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacuacagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugauccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaugaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8677 - RNA, 5067 nt, Artificial Sequence
  derived and/or modified CDS sequence (opt4) from CCHFV(1231-CR/TI-2015)__KU161585.1__GP
augcccaucaacaucaugcacacccugcuggugugcuucauccuguaccugcagcugcugggccugggcggcgcccacgagcagagcaacgccaccgaccacaacagaaccaacaccaucaccgcccccagcaccagccagaaccccaagccccccgccagcaccacccccccccacacccccgagagcagcaccaucaagcugaucaccagcaccggcgaggccgagggcagcggcgagaccacccccccccugaacaccacccagggccccuucccccccgagaccaccagcgagcaccccgccagcaccgccaccaacaccagcagcaccaacagcaugaacagcaccacccagaugaccgacaagacccugaccagcaccgugagcaccagccugagcaucagccccagcacccccagcaccagccagggcauccacuaccccaucagaagccugcugagcgugagcagccccagaaccgccgccacccccacccccaugagcaccagagagaugagcagcgagaccaacagccagcacagcgccgugagcagaacccccaccuuccacaccgccacccaggugagcaccgagaacgacaacagaagcacccccagacagagcgagagcagcgcccagcccgccacccagagccccaugaccagccccgcccagagcauccugcuggugagcgccgcccccaccaccauccagaacauccaccccagccccaccaacagaagcaagagaaaccuggagauggagaucauccugacccugccccagggccugaagaaguacuacggcaagauccugaagcugcugcaccugacccuggaggaggacaccgagggccugcuggaguggugcaagagaaaccugggcagcaacugcgacgacgaguucuuccagaagagaaucgaggaguucuucaucaccggcgagggcuacuucaacgaggugcugcaguucaagacccugagcacccugagccccauggagcccagccacgccagaccccccaccgccgagcccuucaagagcuacuucgccaagggcuuccugagcaucgacagcggcuacuucagcgccaagugcuaccccagaagcagcagcagcggccugcagcugaucaacaucacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaccaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggagagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccauggaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8678 - RNA, 5067 nt, Artificial Sequence
  derived and/or modified CDS sequence (opt4) from CCHFV(1-CR/HU-2015)__KU161584.1__GP
augcccaucaacaucaugcacacccugcuggugugcuucauccuguaccugcagcugcugggccugggcggcgcccacgagcagagcaacgccaccgaccacaacagaaccaacaccaucaccgcccccagcaccagccagaaccccaagccccccgccagcaccacccccccccacacccccgagagcagcaccaucaagcugaucaccagcaccggcgaggccgagggcagcggcgagaccacccccccccugaacaccacccagggccccuucccccccgagaccaccagcgagcaccccgccagcaccgccaccaacaccagcagcaccaacagcaugaacagcaccacccagaugaccgacaacacccugaccagcaccgugagcaccagccugagcaucagccccagcacccccagcaccagccagggcauccacuaccccgugagaagccugcugagcgugagcagccccaagaccgccgccacccccacccccaugagcaccagagagaugagcagcgagaccagcagccagcacagcgccaugagcagaacccccaccuuccacaccgccacccaggugagcaccgagaacgccaacagaagcacccccagacagagcgagagcagcgcccagcccgccacccagagccccaugaccagccccgcccagagcaucuuccuggugagcgccgcccccaccaccauccagaacauccaccccagccccaccaacagaagcaagagaaaccuggagauggagaucauccugacccugccccagggccugaagaaguacuacggcaagauccugaagcugcugcaccugacccuggaggaggacaccgagggccugcuggaguggugcaagagaaaccugggcagcaacugcgacgacgaguucuuccagaagagaaucgaggaguucuucaucaccggcgagggcuacuucaacgaggugcugcaguucaagacccugagcacccugagccccaccgagcccagccacgccagaccccccaccgccgagcccuucaagagcuacuucgccaagggcuuccugagcaucgacagcggcuacuucagcgccaagugcuaccccagaagcagcaccagcggccugcagcugaucaacaucacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccauggaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8679 - RNA, 5067 nt, Artificial Sequence
  derived and/or modified CDS sequence (opt4) from CCHFV(V42/81)__GU477490.1__GP
augcccaccaacaccaugcacacccugcuggugugcuucauccuguaccugcagcugcugggccugggcggcgcccacgugcagcccaacgccaccgagcacaacagaaccaacaccaccaccgcccccggcaccagccacagccugaagccccuggugagcaccacccccccccaggcccccgagagcagcaccaucaagcccaccacccccaccagcgagaccgagggcagcggcgaggccaccccccugagcaacaccauccaggcccccagcagccccgagaccaccagcgagagacccgccaccgccgugaucagcaccagcggcaccgacagcaccaacagcaccacccagaccaccgacaacaaccccaccaccaccgugggcaccagccccagcagcagccccagcacccccagcaccccccagggcauccaccaccacgccagaagccugcugagcgugaccagccccgagaccgugaccacccccaagcccaccagccccagagagaugagcagcgagaccagcaaccagcacagcgccaugagcagaacccccacccaccacaccgugacccaggugagcaccgagaacaccagccacagcacccccagacagcccgagagcagcgcccagcccaccagcagcagccccaugaccagccccgcccagagcacccugcugaugagcgccgcccccaccgccgugcagagcauccaccccagccccaccaacagaagcaagagaaaccuggagaccgagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccccagcaccgugagccccaccgagcccagccacgccagacugcccaccgccgagcccuucaagagcuacuucgccaagggcuuccugagcaucgacagcggcuacuucagcgccaagugcuacagcagaagcagcaccagcggccugcagcugaucaacgugacccagcaccccgccagaaucgccgagacccccggccccaagaccaccagccugaagaccaucaacugcaucaaccugagagccagcguguucaaggagaacagagagaucgagaucagcgugcugcugccccagaucgccgugaaccugagcaacugccacguggugaucaacagccacgugugcgacuacagccuggacaccgacggccccgugagacugcccagaaucaaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcaaggagcccggcgacgacugcaucagcagaacccagcugaugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaaggccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccuggagugcccccacaucccccugcugggcaagcuggccaucuacaucugcagaaugagcaaccaccccagaaccaccauggccuuccuguucugguucggcuucggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggugcugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugcaucgugaagggccugguggacagcgugagcgacagcuucuuccccggccugagcgugugcaagaccugcagcaucagcagcaucaacggcuucgagaucgagagccacaagugcuacugcagccuguucugcugccccuacugcagacacugcagcgccgacagagagauccaccagcugcaccugagcaucugcagaaagagaagaaccggcagcaacgugaugcuggccgugugcaagagaaugugcuucagagccaccaucgaggugagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacauccagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaucgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgagaccccccagcuggaccugaaggccagacccgccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggagagcggcaccgacagcaccuucaaggccuucagcgccaugcccaagaccagccugugcuucuacaucguggagagagaguacugcaagagcugcagcgaggacgacacccagaagugcguggagaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggaggacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8680 - RNA, 5067 nt, Artificial Sequence
  derived and/or modified CDS sequence (opt4) from CCHFV(ROS/HUVLV-100)__DQ206448.1__GP
augcccaccaacaucaugcacacccugcuggugugcuucauccuguaccugcagcugcugggccugggcggcgcccacagacagagcaacgccaccgagcacaacggcaccaacaccaccaccgcccccagcaccagccagagccccaagccccuggugagcaccgcccccccccacgcccuggagagcagcaccaucaagcccaccacccccgugagcgagaccgagggcagcggcgagaccacccccccccccaacaccacccagggccccagcccccccgaggccacccccgagagacccaccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggugagcaccgagaacgccaaccacagcgcccccagacagagcgagagcagcgcccagcagaccaccaccagccccaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8681 - RNA, 5067 nt, Artificial Sequence
  derived and/or modified CDS sequence (opt4) from CCHFV(5180-R-2011)__KR814874.1__GP
augcccaccaacaucaugcacacccugcuggugugcuucauccuguaccugcagcugcugggccugggcggcgcccacagacagagcaacgccaccgagcacaacggcaccaacaccaccaccgcccccagcaccagccagagccccaagccccccgugagcaccgccccccccuacgcccccgagagcagcaccaucaagcccaccacccccgccagcgagaccgagggcagcggcgagaccacccccccccccaacaccacccagggccccagcccccccgaggccacccccgagagacccgccaccaccgccaccagcacccccagcaccgacaacaccaacagcaccacccacgccaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaacccccacccugcacaccgccacccaggccagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagagaucagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8682 - RNA, 5067 nt, Artificial Sequence
  derived and/or modified CDS sequence (opt4) from CCHFV(5170-R-2011)__KR814873.1__GP
augcccuucaacaucaugcacacccugcuggugugcuucauccuguaccugcagcugagcggccugggcggcgcccacggccagagcaacgagaccgagcacaacggcaccaacaccaccaccgugcccggcaccagccagagccccaagccccccgccagcaccacccugcagcacacccccgagagcagcaccgugaagcugaccacccccaccagcgagaccgagggcagcggcgagaccacccccccccccaacaccacccagggccugcccccccccggcaccacccccgagagaagcgccaccaccgccaccagcaccagcagcaccgacaacaugaacagcaccacccaggugaccgacaacacccccaccagcaccgugagcaucagccccagcagcagccccagcaugcccagcaccagccagggcauccacuaccccaucagaagccugcugagcgugagcagccccaagaccgugaccacccccacccccaucagccccggcgagaugagccccgagaccagcagccagcacagcgccaugagcagaauccccacccuguacaccgccacccaggugagcaccgagaacaccaacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcugagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8683 - RNA, 5067 nt, Artificial Sequence
  derived and/or modified CDS sequence (opt4) from CCHFV(4701-ST-2009)__KR814872.1__GP
augcccaucaacaucaugcacacccugcuggugugcuucauccuguaccugcagcugagcggccugggcggcgcccacggccagagcaacgccaccgagcacaacggcaccaacaccaccaccgcccccggcaccagccagagccccaagccccccgccagcaccacccugccccacacccccgagagcagcaccgugaagcugaccacccccaccagcgagaccgagggcagcggcgagaccacccccccccccaacaccacccagggccugccccugaccggcaccacccccgagagaagcgccaccaccgccaccagcaccagcagcaccgacaacaugaacagcaccacccaggugaccgacaacacccccaccagcaccgugagcaucagccccagcagcagcagcagcaugcccagcaccccccagggcacccaccaccccgugagaagccugcugagcgugagcagccccaagaccgugaccacccccacccccaugagccccggcgagaugagccccgagaccagcagccagcacagcgccaugagcagagugcccacccuguacaccgccacccaggugagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcggcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8684 - RNA, 5067 nt, Artificial Sequence
  derived and/or modified CDS sequence (opt4) from CCHFV(4574-ST-2008)__KR814870.1__GP
augcccaccaacaucaugcacacccugcuggugugcuucauccuguaccugcagcugcugggccccggcggcgcccacggccagcccaacgccaccgagcacaacagaaccaacaccaccaccgcccccagcaccagccagagccccaagccccccgugagcaccgcccccccccacgcccuggagagccccaccaucaagagcaccacccccaccagcgagaccgagggcagcggcgagaccaccagcccccccaacaccacccagggccccagccugcccgagaccacccccaagagacccgccaccaccgccaccagcacccccagcaccgacaacaccaacagcaccacccacgugaccgacaacaaccccaccagcaccaucagcaccagccccagcagcagccccagcacccccagcacccccagaggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggccagcaccgagaacgccaaccacagcgcccccagacagagcgagagccccgcccagcccaccaccaccagccugaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgaggacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggugagcaccggcagcagaaagcugcugagcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8685 - RNA, 5067 nt, Artificial Sequence
  derived and/or modified CDS sequence (opt4) from CCHFV(4495-ST-2008)__KR814869.1__GP
augcccaccaacaucaugcacacccugcuggugugcuucauccuguaccugcagcugcugggccccggcggcgcccacggccagcccaacgccaccgagcacaacagaaccaacaccaccaccgcccccagcaccagccagagccccaagccccccgugagcaccgcccccccccacgcccuggagagccccaccaucaagagcaccacccccaccagcgagaccgagggcagcggcgagaccacccccccccccaacaccacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcacccccagaggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggccagcaccgagaacgccaaccacagcacccccagacagagcgagagccccgcccagcccaccaccaccagccugaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggugagcaccggcagcagaaagcugcugagcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagagaugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8686 - RNA, 5067 nt, Artificial Sequence
  derived and/or modified CDS sequence (opt4) from CCHFV(3809-ST-2007)__KR814867.1__GP
augcccaccaacaucaugcacacccugcuggugugcuucauccuguaccugcagcugcugggccugggcggcgcccagggccagagcaacgccaccgagcacaacgagaccaacaccaccaccgcccccagcaccagccagagccccaagccccccgugagcaccaccccccugcacgcccuggagagcagcaccaucaagcccaccacccccgccagagagaccgagggcagcggcgagaccacccccccccccaacaccacccagggccccagcccccccgaggccacccccgagagacccgccaccaccgccaccagcgcccccagcaccgacaacaccaacagcaccacccacgugaccgacaacaaccccaccagcaccaucagcaccagccccagcagcagccccagcacccccuucaccccccagggcauccaccaccccgccagaaaccugcugagcgugagcagccccaagaccgccaccacccccacccccaccagccccggcgagcugagcagcgagaccagcagccugcacagcgccaucagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccgccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcgugugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcagaagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccugacccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8687 - RNA, 5067 nt, Artificial Sequence
  derived and/or modified CDS sequence (opt4) from CCHFV(3756-ST-2007)__KR814866.1__GP
augcccaucaacaucaugcacacccugcuggugugcuucauccuguaccugcagcugagcggccugggcggcgcccacggccagagcaacgccaccgagcacaacagaaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugccccugcccggcaccacccccgagagaagcgccaccaccgccaccagcaccagcagcaccgacaacaugaacaccaccacccaggugaccgacaacacccccaccagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaucaacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccugacccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8688 - RNA, 5067 nt, Artificial Sequence
  derived and/or modified CDS sequence (opt4) from CCHFV(81-R-2014)__KR814865.1__GP
augcccaccaacaucaugcacacccugcuggugugcuucauccuguaccugcagcugcugggccugggcggcgcccacggccagagcaacgccaccgagcacaacggcaccaacaccaccaccgugcccagcaccagccagagccccaagccccuggugagcaccacccccccccacgcccuggagagcagcaccaucaagcccaccacccccaccagcgagaccgagggcagcggcgagaccgccccccugcccaacaccacccagggcccccccccccccgagaccacccccgagagacccgccaccaccgugaccagcacccccagcaccgacaacaccaacagcaccauccacgugaccgacaacaaccccaccagcaccaucagcaccagccccagcagcagccccagcacccccagcaccccccagggcauccaccaccccgccagaagccugcugagcgugagcagccccaagaccgccaccacccccacccccaccagccccggcgagaucaacagcgagaccagcagccugcacagcgccaugagcagaacccccacccugcacaccgccacccaggugagcaccgagaacgccaaccacagcgcccccagacagagcgagagcagcgcccagcccaccaccaccagccugaugaccagccccgcccagagcauccugcugaugagcgccgcccccaccgccauccagaacacccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucggcgaguucuucaugaccggcgagggcuacuucaacgaggugcugcaguucaagacccugagcacccugagccccaccgagcccagccacgccagacugcccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8689 - RNA, 5067 nt, Artificial Sequence
  derived and/or modified CDS sequence (opt4) from CCHFV(75-ST-2010)__KR814864.1__GP
augcccaccaacaucaugcacacccugcuggugugcuucauccuguaccugcagcugcugggccccggcggcgcccacggccagcccaacgccaccgagcacaacagaaccaacaccaccaccgcccccagcaccagccagagccccaagccccccgugagcaccgcccccccccacgcccuggagagccccaccaucaagagcaccacccccaccagcgagaccgagggcagcggcgagaccacccccccccccaacaccacccagggccccagccugcccgagaccacccccgagagacccgccaccaccgccaccagcacccccagcaccgacaacaccaacagcaccacccacgugaccgacaacaaccccaccagcaccaucagcaccagccccagcagcagccccagcacccccagcacccccagaggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggccagcaccgagaacgccaaccacagcgcccccagacagagcgagagccccgcccagcccaccaccaccagccugaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggugagcaccggcagcagaaagcugcugagcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8690 - RNA, 5067 nt, Artificial Sequence
  derived and/or modified CDS sequence (opt4) from CCHFV(75-R-2012)__KR814863.1__GP
augcccaccaacaucaugcacacccugcuggugugcuucauccuguaccugcagcugcugggccugggcggcgcccacagacagagcaacgccaccggccacaacggcaccaacaccaccaccgcccccagcaccagccagagccccaagccccuggugagcaccgcccccccccacgcccuggagagcagcaucaucaagcacaccacccccgugagcgagaccgagggcagcggcgagaccacccccccccccaacaccacccagggccccagcccccuggagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccugaagaccgccaccacccccacccccaccagccccggcgagaucagcagcgagaccagcagccugcacagcgccaugagcagaaccagcacccuguacaccgccacccaggugagcaccgagaacgccaaccacagcgcccccagacagagcgagagcagcgcccagcagaccaccaccagccccaugaccagccccgcccagagcauccuggugaugagcgccgcccccaccgccauccagaacacccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccagagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcgcccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccuggugaacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuuccuguacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8691 - RNA, 5067 nt, Artificial Sequence
  derived and/or modified CDS sequence (opt4) from CCHFV(52-R-2014)__KR814862.1__GP
augcccaccaacaucaugcacacccugcuggugugcuucauccuguaccugcagcugcugggccugggcggcgcccacagacagagcaacgccaccgagcacaacggcaccaacaccaccaccgcccccagcaccagccagagccccaagccccccgugagcaccgcccccccccacgcccccgagagcagcaccaucaagcccaccacccccgccagcgagaccgagggcagcggcgagaccacccccccccccaacaccacccagggccccagcccccccgaggccacccccgagagacccgccaccaccgccaccagcacccccagcaccgacaacaccaacagcaccacccacgccaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaacccccacccugcacaccgccacccaggccagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacgugccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccggcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8692 - RNA, 5067 nt, Artificial Sequence
  derived and/or modified CDS sequence (opt4) from CCHFV(47-ST-2013)__KR814861.1__GP
augcccaucaacaucaugcacacccugcuggccugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagaagcgccaccaccgccaccagcaccagcagcaccgacaacaugaacagcaccacccagaugaccggcaacacccccacccccaccgugaacaugagccccagcagcagccccagcaugcccagcaccagccagggcauccacuaccccgugagaagccugcugagcgugcccagccccaagaccgccaccacccccacccccgugagccccggcgagaugagccccgagaccagcagccagcacagcgccaccagcagaauccccacccuguacaccgccacccaggugagcaccgagaacaccaacagaagcacccccagacagagcaagagcagcgugcagcccgccacccagagccccaucaccccccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuacgccaagggcuuccugagccuggacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacccccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccuguucaucagaagcaucaucaacaccaccuucgugaccugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgagugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8693 - RNA, 5067 nt, Artificial Sequence
  derived and/or modified CDS sequence (opt4) from CCHFV(46-ST-2012)__KR814860.1__GP
augcccaccaacaucaugcacacccugcuggugugcuucauccuguaccugcagcugcugggccugggcggcgcccacggccagagcaacgccaccgagcacaacggcaccaacaccaccaccgugcccagcaccagccagagccccaagccccuggugagcaccacccccccccacgcccuggagagcagcaccaucaagcccaccacccccaccagcgagaccgagggcagcggcgagaccgccccccugcccaacaccacccagggcccccccccccccgagaccacccccgagagacccgccaccaccgugaccagcacccccagcaccgacaacaccagcagcaccauccacgugaccgacaacaaccccaccagcaccaucagcaccagccccagcagcagccccagcacccccagcaccccccagggcauccaccaccccgccagaagccugcugagcgugagcagccccaagaccgccaccacccccacccccaccagccccggcgagaucaacagcgagaccagcagccugcacagcgccaugagcagaacccccacccugcacaccgccacccaggugagcaccgagaacgccaaccacagcgcccccagacagagcgagagcagcgcccagcccaccaccaccagccugaugaccagccccgcccagagcauccugcugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagacugcccaccguggagcccuucaagagcuacuucgccaagggcuuccugagcguggacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacgccaccuucgugaucugcauccugacccugaccaucugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8694 - RNA, 5067 nt, Artificial Sequence
  derived and/or modified CDS sequence (opt4) from CCHFV(44-ST-2010)__KR814859.1__GP
augcccaucaacaucaugcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaugagcagcaccgacaacaugaacagcaccacccaggugaccgacaacacccccaccagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaccaacagaagcacccccagacagagcgagagcagcgcccagcccgccacccagagccccaccaccagccccacccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccugcugugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcuucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugagcgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggcuga

SEQ ID NO: 8695 - RNA, 5067 nt, Artificial Sequence
  derived and/or modified CDS sequence (opt4) from CCHFV(37-R-2013)__KR814858.1__GP
augcccaccaacaucaugcacacccugcuggugugcuucauccuguaccugcagcugcugggccugggcggcgcccacagacagagcaacgccaccgagcacaacggcaccaacaccaccaccgcccccagcaccagccagagccccaagccccccgugagcaccgcccccccccacgcccccgagaccagcaccaucaagcccaccacccccgccagcgagaccgagggcagcggcgagaccacccccccccccaacaccacccagggccccagcccccccgaggccacccccgagagacccgccaccaccgugaccagcacccccagcaccgacaacaccaacagcaccacccacgccaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaacccccacccugcacaccgccacccaggccagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugaccaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgugaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8696 - RNA, 5067 nt, Artificial Sequence
  derived and/or modified CDS sequence (opt4) from CCHFV(36-ST-2014)__KR814857.1__GP
augcccaucaacaucaugcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaugagcagcaccgacaacaugaacagcaccacccaggugaccgacaacacccccaccagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaccaacagaagcacccccagacagagcgagagcagcgcccagcccgccacccagagccccaccaccagccccacccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugagcgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaaguuccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggcuga

SEQ ID NO: 8697 - RNA, 5067 nt, Artificial Sequence
  derived and/or modified CDS sequence (opt4) from CCHFV(24-R-2012)__KR814856.1__GP
augcccaccaacaucaugcacacccugcuggugugcuucauccuguaccugcagcugcugggccugggcggcgcccacagacagagcaacgccaccgagcacaacggcaccaacaccaccaccgcccccagcaccagccagagccccaagccccccgugagcaccgcccccccccacgcccccgagagcagcaccaucaagcccaccacccccgccagcgagaccgagggcagcggcgagaccacccccccccccaacaccacccagggccccagcccccccgaggccacccccgagagaaccgccaccaccgccaccagcacccccagcaccgacaacaccaacagcaccacccacgccaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaacccccacccugcacaccgccacccaggccagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8698 - RNA, 5064 nt, Artificial Sequence
  derived and/or modified CDS sequence (opt4) from CCHFV(Oman-199809166)__KR864901.1__GP
augcccgugaacaccaugcacacccugcugguguacgccguguucugccugcagcuguggagccccggcggcaccagaggccugagcaacgagacccagcacaacgagaccggcaucaccagagcccccgagggcagccagggccccagccugcccgugagcaccgccagccccaucaugagcgaccccagcaucaccacccugagcgccagcaccagcggccuggagggcagcggcgacaccaccccccccgccaucacccagggccccacccugcccgagaccacccccgagcccagcaccaccaccggcaccaacgccuucagcaccgccaucgccaacgugagcacccagaccgugaaggacacccccacccccaccgugcagaccagcccccccagcacccccgacgccagcaccaucccccagggcacccaccacaccgccagaggccugcugagcgugaccgugaccaagcccgaggaggugcccacccccaccggccccgagcaggccagcaucgagaccaacagcagcagacuggccaccagcaagacccccagccccagccccaccgcccaggugaccaccgagaacagcaaccccaacaccagcagacagcuggugcugagcacccagcccgccaccagcagccccgugaccagccccgcccagcugaacuucgugcagagcgccaccaccaucgccgugcaggacgcccaccccagccccaccaacagaagcaagagaaaccuggagauggaggugauccugacccugagccagggccugagaaaguacuacggcagaauccugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagagcgccagcgugggccugcccaccguggagcccuucaagagcuacuucgccaagggcuuccugagcaucgacagcggcuacuucagcgccaagugcuaccccagagccagcaacagcggccugcagcugaucaacgugacccagcacagcgccagaaucgccgacacccccggccccaagaucaccaaccugaagaccaucaacugcaucaaccugaaggcccugguguucaaggagcacagagagaucgagaucaacgugcugcugccccagguggccgugaaccugagcaacugccacgugcacaucaagagccacgugugcgacuacagccuggacaucgacggcaccgugagacugcccagaauccaccacgagggcaccuucauccccggcaccuacaagaucgugaucgacaagaagaacaagcagaacgacagaugcaaccuggugaccaacugcgugaucaagggcagagaggugagaaagggccagagcgugcugagacaguacagaaccgagaucagaaucggcaaggccagcagcggcagcagaagacugcugagcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8699 - RNA, 5064 nt, Artificial Sequence
  derived and/or modified CDS sequence (opt4) from CCHFV(Oman_812956)__KY362518.1__GP
augcccgugaacaccaugcacacccugcugguguacgccguguucugccugcagcuguggagccccggcggcaccagaggccugagcaacgagacccagcacaacgagaccggcaucaccagagcccccgagggcagccagggccccagccugcccgugagcaccgccagccccaucaugagcgaccccagcaucaccacccugagcgccagcaccagcggccuggagggcagcggcgacaccaccccccccgccaucacccagggccccacccugcccgagaccacccccgagcccagcaccaccaccggcaccaacgccuucagcaccgccaucgccaacgugagcacccagaccgugaaggacacccccacccccaccgugcagaccagcccccccagcacccccgacgccagcaccaucccccagggcacccaccacaccgccagaggccugcugagcgugaccgugaccaagcccgaggaggugcccacccccaccggccccgagcaggccagcaucgagaccaacagccccagacuggccaccagcaagacccccagccccagccccaccgcccaggugaccaccgagaacagcaaccccaacaccagcagacagcuggugcugagcacccagcccgccaccagcagccccgugaccagccccgcccagcugaacuucgugcagagcgccaccaccaucgccgugcaggacgcccaccccagccccaccaacagaagcaagagaaaccuggagauggaggugauccugacccugagccagggccugagaaaguacuacggcagaauccugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagagcgccagcgugggccugcccaccguggagcccuucaagagcuacuucgccaagggcuuccugagcaucgacagcggcuacuucagcgccaagugcuaccccagagccagcaacagcggccugcagcugaucaacgugacccagcacagcgccagaaucgccgacacccccggccccaagaucaccaaccugaagaccaucaacugcaucaaccugaaggcccugguguucaaggagcacagagagaucgagaucaacgugcugcugccccagguggccgugaaccugagcaacugccacgugcacaucaagagccacgugugcgacuacagccuggacaucgacggcaccgugagacugcccagaauccaccacgagggcaccuucauccccggcaccuacaagaucgugaucgacaagaagaacaagcagaacgacagaugcaaccuggugaccaacugcgugaucaagggcagagaggugagaaagggccagagcgugcugagacaguacagaaccgagaucagaaucggcaaggccagcagcggcagcagaagacugcugagcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucuucgacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8700 - RNA, 5064 nt, Artificial Sequence
  derived and/or modified CDS sequence (opt4) from CCHFV(Oman)__DQ211632.1__GP
augcccgugaacaccaugcacacccugcugguguacgccguguucugccugcagcuguggagccccggcggcaccagaggccugagcaacgagacccagcacaacgagaccggcaucaccagagcccccgagggcagccagggccccagccugcccgugagcaccgccagccccaucaugagcgaccccagcaucaccacccccagcgccagcaccagcggccuggagggcagcggcgacaccaccccccccgccaucacccagggccccaccccccccgagaccacccccgagcccagcaccaccaccggcaccaacgccuucagcaccgccaucgccaacgugagcacccagaccgugaaggacacccccacccccaccgugcagaccagcccccccagcacccccgacgccagcaccaucccccagggcacccaccacaccgccagaggccugcugagcgugaccgugaccaagcccgaggaggugcccacccccaccggccccgagcaggccagcaucgagaccaacagccccagacuggccaccagcaagacccccagccccagccccaccgcccaggugaccaccgagaacagcaaccccaacaccagcagacagcuggugcugagcacccagcccgccaccagcagccccgugaccagccccgcccagcugaucuucgugcagagcgccaccaccguggccgugcaggacgcccaccccagccccaccaacagaagcaagagaaaccuggagauggaggugauccugacccugagccagggccugagaaaguacuacggcagaauccugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagcagcaccgagagcgccagcgugggccugcccaccguggagcccuucaagagcuacuucgccaagggcuuccugagcaucgacagcggcuacuucagcgccaagugcuaccccagagccagcaacagcggccugcagcugaucaacgugacccagcacagcgccagaaucgccgacacccccggccccaagaucaccaaccugaagaccaucaacugcaucaaccugaaggcccugguguucaaggagcacagagagaucgagaucaacgugcugcugccccagguggccgugaaccugagcaacugccacgugcacaucaagagccacgugugcgacuacagccuggacaucgacggcaccgugagacugcccagaauccaccacgagggcaccuucauccccggcaccuacaagaucgugaucgacaagaagaacaagcagaacgacagaugcaaccuggugaccaacugcgugaucaagggcagagaggugagaaagggccagagcgugcugagacaguacagaaccgagaucagaaucggcaaggccagcagcggcagcagaagacugcugagcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuucugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8701 - RNA, 5064 nt, Artificial Sequence
  derived and/or modified CDS sequence (opt4) from CCHFV(3820-ST-2007)__KR814868.1__GP
augcccaucaacaucaugcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccaccccccccaacaccacccagggccugccccugcccggcaccacccccgagagaagcgccaccaccgccaccagcaccagcagcaccgacaacaugaacagcaccacccaggugaccgacaacacccccaccagcaccgugagcaucagccccagcagcagcagcagcaugcccagcaccagccagggcauccaccaccccgugagaagccugcugagcgugagcagccccaagaccgugaccacccccacccccaugagccccggcgagaugagccccgagaccagcagccagcacagcgccaugagcagagugcccacccuguacaccgccacccagaucagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaagaccagcaccggcagcagaaagcugcugagcgaggagcccggcgacgacugcaucagcagaacccagcugcugaagaccgagaccgccgagauccacgacgacaacuacggcagccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcuggccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8702 - RNA, 5058 nt, Artificial Sequence
  derived and/or modified CDS sequence (opt4) from CCHFV(SR3)__AJ538199.1__GP
augcacaucagccugauguacgccguguucugccugcagcugugcggccugggcaagaccaacggcccccacaacggcaccgagcacaacaacacccacgugaugaccacccccgacgacagccagagccccgagccccccgugagcaccgcccugcccgugacccccgaccccagcaccgugacccccagcacccccgccagcggccuggagggcagcggcgagguguacaccagcagccccaucaccaccaagggccugagccugcccgaggccaccagcgagccccccgccaccaccagcguggugaccagcagcgccagcgacaccgacagcagcacccaggccgccggcgacacccccacccccaccgugagaaccagccugcccagcagccccagcacccccagcaccagccagggcacccacuaccccgugagaagccugcugagcgugaccagccccaagcccgaggagacccccacccccagcaagagcggcaaggacgaccuggccaccaacagcccccaccccgccaccagcagacccaccaccccccccaccaccgcccagaagcccaccgagaacaacagccacaacaccaccgagcagcuggagagccugacccaccuggccacccugggccugaugaucagccccacccagaccgugcugccccagagcgugaccagcaucgccauccaggacauccacaacagccccaccaacagaagcaagagaaaccuggacauggagaucauccugacccugagccagggccugaagaaguacuacggcaagauccugaagcugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccugggcacccugagcaccaccgagagcacccacgccggcagccccaccguggagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucaacugcaugaaccugaaggccagcguguucaaggagcacagagagguggagaucaacgugcugcugccccagguggccgugaaccugagcaacugccacguggccaucaagagccacaucugcgacuacagccuggacaccgacggcgccaucagacugccccagauccaccacgagggcaccuucauccccggcaccuacaagaucgugaucgacaagaagagcagacugaacgacagaugcacccuguucaccaacugcgugaucaagggcagagaggugagaaagggccagagcgugcugagacaguacaagaccgagaucagaaucggcagagccagcaccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacaagugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucgugaugugcauccugaagggcgaguucgccgccgugaagagcauccaccccaucgagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcaacaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8703 - RNA, 5055 nt, Artificial Sequence
  derived and/or modified CDS sequence (opt4) from CCHFV(SPU 187/90)__KJ682814.1__GP
augcacaucagccugauguacgccgugcugugccugcagcugugcagccugggcgagacccacagaagccacaacgagaucggccacaacaagaccgacgugaugaccacccccggcgacaaccugagcagcgagcagcccgugagcaccgcccugagcaucacccccgaccccagcaccgugacccccaccacccccgccagcggcagcgagggcagcggcgagguguacaccagcagccccaucaccaccgagagccugagccugcccgagaccacccccgagcugcccgccaccaccggcaucgacagcagcagcgccagcggcguggacagcagcacccaggccgccggcggcaccagcgcccugaccgugagaaccagccugcccaacagccccagcacccccagcaccccccaggacaccuaccaccccgugagaauccugcugagcgugaccggccccggccccgaggagaccagcacccccagcggcagcggcaaggagagcagcgccaccagcagccugcaccccaucagcgacagacugcccaccccccccgccaccgcccagggccccaccgagaacaacagccacaacgccaccgagcaccccaagccccugacccagagcgccacccccggccugaugaccagccccacccagaucgugcacccccagagcgccaccagcaucaccgugcaggacaccuaccccagccccaagaacagaagcaagagaaaccuggagauggagaucauccugacccugagccagggccugaagaaguacuacggcaagauccugagacugcugagacugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucaagacccccggcacccugagcaccaccgagagcacccccgccgagcugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagaucgccgugaaccugagcaacugccacguggugaucaagagccacgugugcgacuacagccuggacaucgacggcaccgugagacugccccacaucuaccacgagggcguguucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgaggccuacagagccagagagggcuacaccagcaucugccuguucgugcugggcagcauccuguucguggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaucuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaagaccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8704 - RNA, 5055 nt, Artificial Sequence
  derived and/or modified CDS sequence (opt4) from CCHFV(SPU 48/90)__KJ682813.1__GP
augcacaucagccugauguacgccgugcugugccugcagcugugcggccugggcgagacccacagaagccacaacgagaccggccacaacaagaccgacguggccaccacccccggcgacaaccugagcagcgagcagcuggugagcaccgcccugagcaucacccccgaccccagcaccgugacccccaccaccagcgccagcggccuggagggcagcggcgagguguacaccagcagccugaucaccaccgagagccugagccugcuggagaccacccccaagcugcccaccaccaccggcaucgacaccagcagcgccagcgacguggacagcagcacccaggccgccggcgacaccagcgcccugaccgugagaaccagcccccccagcaaccccagcacccccagcaccccccaggacacccaccaccccaugagaaaccugcugagcgugaccagccccggccccgaggagaccagcacccccagcggcagcggcaaggagagccccgccaccagcagcccccaccccgugagcaacagaagccagaccccccccgccaccgcccagggccccaccgaggacaacagcuacaacgccaccgagcaccccgagcaccugacccagagcgccaccagcggccugaugaccagccccacccagaucgugcacccccagagcgccaccagcaucaccgugcaggacaccuaccccagccccaccaacagaagcaagagaaaccuggagauggagaucauccugacccugagccagggccugaagaaguacuacggcaagauccugagacugcugagacugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucaagacccccggcacccugagcaccaccgagagcacccccgccgagccccccaccgccgagcccuucaagagcuacuucgccaagggcuuccugagcaucgacagcggcuacuacagcgccaagugcuacagcggcaccagcaacagcggccugcagcugaucaacaucaccagacacagcaccaagaucgccgacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacccccuggacaucgacggcaccgugagacugccccacaucuaccacgagggcguguucauccccggcaccuacaagaucgugaucgacaagaagaccaagcugaacgacagaugcacccuguucaccgacugcgugaucaagggcagagaggugagaaagggccagagcgugcugagacaguacaagaccgagaucagaaucggcaagaccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgugaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaccaccaccauggccuuccuguucugguucagcuucggcuacgugaucaccugcauccugugcaaggccaucuucuaccugcugaucaucaucggcacccugggcaagagauucagacaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgaggccuacagagccagagagggcuacaccagcaucugccuguucgugcugggcagcauccuguucguggugagcugccugaugaagagacugguggacagcgugggcaacagcuucuuccccggccugagcaucugcaagaccugcagcaucagcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcgacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguucagagacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaacagagccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagaaggaguacugcaagagcugcagcgaggaggacaccaagaagugcgugaacaccaagcuggagcagccccagagcauccugaucgagcacaagggcaccaucaucggcaagcagaacagcaccugcaccgccaaggugagcugcuggcuggagagcgccaagagcuucuucuacggccugaaggacaugcugagcggcaucuucggcaacguguucaucggcaucuuccuguuccuggcccccuucauccugcugauccuguucuucauguucggcuggagaauccugcugugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8705 - RNA, 5055 nt, Artificial Sequence
  derived and/or modified CDS sequence (opt4) from CCHFV(Sudan AB1-2009)__HQ378187.1__GP
augcacaucagccugaucuacgccauccugugccugcagcugugcggccugggcgagacccacggcagccacaacgagaccagacacaacaagaccgacaccaucaccacccccggcgacaaccugagcagcgagcccagcgugagcaccgcccugagcaucacccccgaccccagcaccgugacccccaccacccccgccagcggccuggagggcagcggcgagguguacaccagcccccccaucaccaccggcagccugccccugcccggcaccacccccgagcugcccgccaccaccggcaccgacaccagcagcgccagcgacguggacagcagcacccagaccgccggcggcaccuucacccugaccgugagaaccagccugcccagaagccccagcacccccagcaccccccaggacacccaccaccccgugagaaaccugcugagcgugaccagccccggccccgacgagaccagcacccccagcggcaccggcaaggagagccccgccaccagcagcccccaccccgugagcaacagaccccccaccccccccgccaccgcccagggccccaccgagaacgacagccacaacgccaccgagcaccccgagagccugacccagagcgccaccaccggccccaugaccagccccacccagaucgugcacccccagagcgccacccccaucaccgugcaggacacccaccccagccccaccaacagaagcaagagaaaccuggagauggagaucauccugacccugagccagggccugaagaaguacuacggcaagauccugagacugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccaacugcgugaucaagggcagagaggugagaaagggccagagcgugcugagacaguacaagaccgaggugagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuaccugaucaccugcauccugugcaaggccaucuucuaccugcugaucaucaucggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcaacgaggaggacaccaagaagugcgugaacaccaagcuggagcagccccagagcauccugaucgagcacaagggcaccaucaucggcaagcagaacagcaccugcaccgccagagccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8706 - RNA, 5055 nt, Artificial Sequence
  derived and/or modified CDS sequence (opt4) from CCHFV(Sudan Al-Fulah 9-2008)__HQ378185.1__GP
augcacaucagccugauguacgccgugcugugccugcagcugugcggccugggcgagacccacagaagccacaacgagaccgugcacaacaagaccgacaucgugaccacccccagcgacgaccugagcagcgagcagcuggugagcaccgcccugagcaucacccccgaccccagcaccgugacccccaccaccagcgccagcggccuggagggcagcggcgagguguacaccagcagccccaucaccaccgagagccugagccagcccgagaccacccccaagcugcccgccaccaccggcaucgacaccagcagcgccagcgacguggacagcagcacccaggccgccggcgacaccagcacccugaccgugagaaccagcccccccaacagccccagcacccccagcaccccccaggacacccaccaccccaugagaaaccugcugagcgugaccagccccggccccgaggagaccagcacccccagcggcagcggcaaggagagcagcgccaccagcagcccccaccccgugagcaacagaccccagaccccccccgccaccgcccagggccccaccgaggacaacagccacaacgccaccgagcaccccgagcaccugacccagagcgccaccagcggccccaugaccagccccacccagaucgugcacccccagagcgccaccaccaucaccgugcaggacaccuaccccagccccaccaacagaagcaagagaaaccuggagauggagaucauccugacccugagccagggccugaagaaguacuacggcaagauccugagacugcugagacugacccuggaggaggacaccgagggccugcuggaguggugcaagagaaaccugggccuggacugcgacgacaccuucuuccagaagagaaucgaggaguucuucaucaccggcgagggccacuucaacgacgugcugcaguucaagacccccggcacccugagcaccaccgagagcacccccgccaagccccccaccgccgagcccuucaagagcuacuucgccaagggcuuccugaccaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacccccuggacaucgacggcaccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgugaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucagacaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagaaggaguacugcaagagcugcagcgaggaggacaccaagaagugcgugaacaccaagcuggagcagccccagagcauccugaucgagcacaagggcaccaucaucggcaagcagaacagcaccugcaccgccaaggugagcugcuggcuggagagcgccaagagcuucuucuacggccugaaggacaugcugagcggcaucuucggcaacguguucaucggcaucuuccuguuccuggcccccuucgugcugcuggugcuguucuucauguucggcuggagaauccugcugugcuucagaugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaaagaucgccgagcuguucagcaccaagacccacaucggcuga

SEQ ID NO: 8707 - RNA, 5055 nt, Artificial Sequence
  derived and/or modified CDS sequence (opt4) from CCHFV(SPU4/81)__DQ157175.1__GP
augcacaucagccugauguacgccgugcugugccugcagcugugcggccugggcgagacccacggcagcuacaacgagaccggccacaacaagaccgacgugaugaccacccccggcgacaaccugagcagcgagcagcccgugagcaccgcccugagcaucacccccgaccccagcaccgugacccccaccacccccgccaacggccuggagggcagcggcgagguguacaccagcagccccaucaccaccgagagccugagccugcccgagaccacccccgagcugcccgccaccgccggcaucgacaccagcagcgccagcgacguggacagcagcacccaggccgccggcggcaccagcgcccccaccgugagaaccagccugcccaacagccccagcacccccagcaccccccaggagacccaccaccccgugagaaaccugcugagcgugaccagccugggccccgaggagaccagcacccccagcggccccggcaaggagagcagcgccaccagcagcccccaccccgugagcaacaagccccccaccccccccgccagagcccagggccccaccgagaacaacagccacaacgccaccgagcaccccgagccccugacccagagcgccacccccggccugaugaccagccccacccagguggugcacccccagagcgccaccagcaucaccgugcaggacaccuaccccagccccaccaacagaagcaagagaaaccuggagaccgagaucauccugacccugagccagggccugaagaaguacuacggcaagauccugagacugcugagacugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucaagacccccggcacccugagcaccaccgagagcacccccgccgagcugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccaggccgccgugaaccugagcaacugccacguggugaucaagagccacgugugcgacuacagccuggacaucgacggcaccgugagacugccccacaucuaccacgagggcguguucauccccggcaccuacaagaucgugaucgacaagaaggacaagcugaacgacagaugcacccuguucaccgacugcgugaucaagggcagagaggugagaaagggccagagcgugcugagacaguacaagaccgagaucagaaucggcaaggccagcaucggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgagagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaucggcaucuuccuguuccugggccccuucauccugcugauccuguucuucauguucggcuggagaauccuguucugcuucaagugcugcagaagaaccagaggccugcugaaguacagacaccugaaggaggacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8708 - RNA, 5055 nt, Artificial Sequence
  derived and/or modified CDS sequence (opt4) from CCHFV(NIV 11703)__JN572086.1__GP
augcacaccagccugaucuacguggugcugugccugcagcugugcagccugggcaagacccacggcagccacaacggcaccgagcacaacaagaccgacgugaugaccacccccggcgacaaccagagccccgagccccuggugagcaccgcccugcccgugacccccgaccccagcaccgugacccccaccgcccccgccagcggccuggagggcagcggcgagguguacaccagcagcagcaucaccaccaagggccugagccugcccaaggccaccagcgagcugcuggccaccaccggcauggugaccagcagcgccagcgacaucgaccccagcacccaggccgccggcgacacccccacccccaccgugagaaccagccugcccaacagccccagcacccccagcaccagccaggacacccaccaccccgugagaaaccugcugagcgugaccagccccaagcccgaggagacccccacccccagcaagagcgacaaggacagcagcgccaccaacagcccccaccccgccgccagcagacugagcaccccccccaccaccgaccagggccccaccgagaacaacaaccacaacagcaccgagcagcuggagagccugaccagaagcgccaccagcagcagcauggugagccugacccagaccgugcugccccagagcgccaccagcaucgccacccaggacacccaccccagccccaccaacagaagcaagagaaaccuggagauggagaucauccugacccugccccagggccugaagaaguacuacggcaagauccugaagcugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagagcccccggcacccugagcaccaccgagcccacccacgccggcagccccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucaacugcaucaaccugaaggccagcguguucaaggagcacagagagguggagaucaacgugcugcugccccagguggccgugaaccugagcaacugccacguggccaucaagagccacgugugcgacuacagccuggacaccgacggcgccaucagacugccccacauccacuacgagggcaccuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcagagccagcaccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggugaucuucuaccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcaucgcccugaagagaagcagcuggcugaucgugcugcuggugcuguucaccgugagcaucacccccgugcagagcgcccccaucggccacggcaagaccaucgaggccuacagagccagagaggaguacaccagcaucugccuguucgugcugggcagcgugcuguucguggugagcugccugaugaagggccugguggacagcgugggcaacaucuucuuccccggccuguucaucugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagaaccaccauggaggugagcaacaaggcccuguucgugagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggagagcggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8709 - RNA, 5055 nt, Artificial Sequence
  derived and/or modified CDS sequence (opt4) from CCHFV(NIV 112143)__JN572085.1__GP
augcacaccagccugaucuacguggugcugugccugcagcugugcagccugggcaagacccacggcagccacaacggcaccgagcacaacaagaccgacgugaugaccacccccggcgacaaccagagccccgagccccuggugagcaccgcccugcccgugacccccgaccccagcaccaucacccccaccgcccccgccagcggccuggagggcagcggcgagguguacaccagcagcagcaucaccaccaagggccugagccugcccaaggccaccagcgagcugcuggccaccaccggcauggugaccagcagcgccagcgacaucgaccccagcacccaggccgccggcgacacccccacccccaccgugagaaccagccugcccaacagccccagcacccccagcaccagccaggacacccaccaccccgugagaaaccugcugagcgugaccagccccaagcccgaggagacccccacccccagcaagagcgacaaggacagcagcgccaccaacagcccccaccccgccgccagcagacugagcaccccccccaccaccgaccagggccccaccgagaacaacaaccacaacagcaccgagcagcuggagagccugaccagaagcgccaccagcagcagcauggugagccugacccagaccgugcugccccagagcgccaccagcaucgccacccaggacacccaccccagccccaccaacagaagcaagagaaaccuggagauggagaucauccugacccugccccagggccugaagaaguacuacggcaagauccugaagcugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagagcccccggcacccugagcaccaccgagcccacccacgccggcagccccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucaacugcaucaaccugaaggccagcguguucaaggagcacagagagguggagaucaacgugcugcugccccagguggccgugaaccugagcaacugccacguggccaucaagagccacgugugcgacuacagccuggacaccgacggcgccaucagacugccccacauccacuacgagggcaccuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcagagccagcaccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggugaucuucuaccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcaucgcccugaagagaagcagcuggcugaucgugcugcuggugcuguucaccgugagcaucacccccgugcagagcgcccccaucggccacggcaagaccaucgaggccuacagagccagagaggaguacaccagcaucugccuguucgugcugggcagcgugcuguucguggugagcugccugaugaagggccugguggacagcgugggcaacaucuucuuccccggccuguucaucugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccuguucgugagaagcaucaucaacaccaccuucguggugugcauccugauccuggccaucugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8710 - RNA, 5055 nt, Artificial Sequence
  derived and/or modified CDS sequence (opt4) from CCHFV(NIVA 118594)__JN572084.1__GP
augcacaccagccugaucuacguggugcugugccugcagcugugcagccugggcaagacccacggcagccacaacggcaccgagcacaacaagaccgacgugaugaccacccccggcgacaaccagagccccgagccccuggugagcaccgcccugcccgugacccccgaccccagcaccgugacccccaccgcccccgccagcggccuggagggcagcggcgagguguacaccagcagcagcaucaccaccaagggccugagccugcccaaggccaccagcgagcugcuggccaccaccggcauggugaccagcagcgccagcgacaucgaccccagcacccaggccgccggcgacacccccacccccaccgugagaaccagccugcccaacagccccagcacccccagcaccagccaggacacccaccaccccgugagaaaccugcugagcgugaccagccccaagcccgaggagacccccacccccagcaagagcgacaaggacagcagcgccaccaacagcccccaccccgccgccagcagacugagcaccccccccaccaccgaccagggccccaccgagaacaacaaccacaacagcaccgagcagcuggagagccugaccagaagcgccaccagcagcagcauggugagccugacccagaccgugcugccccagagcgccaccagcaucgccacccaggacacccaccccagccccaccaacagaagcaagagaaaccuggagauggagaucauccugacccugccccagggccugaagaaguacuacggcaagauccugaagcugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagagcccccggcacccugagcaccaccgagcccacccacgccggcagccccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucaacugcaucaaccugaaggccagcguguucaaggagcacagagaguucgagaucaacgugcugcugccccagguggccgugaaccugagcaacugccacguggccaucaagagccacgugugcgacuacagccuggacaccgacggcgccaucagacugccccacauccacuacgagggcaccuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcagagccagcaccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggugaucuucuaccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcaucgcccugaagagaagcagcuggcugaucgugcugcuggugcuguucaccgugagcaucacccccgugcagagcgcccccaucggccacggcaagaccaucgaggccuacagagccagagaggaguacaccagcaucugccuguucgugcugggcagcgugcuguucguggugagcugccugaugaagggccugguggacagcgugggcaacaucuucuuccccggccuguucaucugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagaaccaccauggaggugagcaacaaggcccuguucgugagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggagagcggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8711 - RNA, 5055 nt, Artificial Sequence
  derived and/or modified CDS sequence (opt4) from CCHFV(UCCR4448)__KY484042.1__GP
augcacaucagccugauguacgccgugcugugccugcagcugugcggccugggcgagacccacggcagccacaacgagaccggccacaacaagaccgacgugaugaccacccccggcgacaaccugagcagcgagcagcccgugagcaccgcccugagcaucacccccgaccccagcaccgugacccccaccacccccgccagcggccuggagggcagcggcgagguguacaccagcccccccaucaucaccgagagccugagccugcccgagaccacccccgagcugagcgccaccgccggcaucgacaccagcagcgccagcgacguggacagcagcacccaggccgccagaggcaccagcgcccugaccgugagaaccagccugcccaacagccccagcacccccagcaccccccaggagacccaccaccccgugagaaaccugcugagcgugaccagccccagacccgaggagaccagcacccccagcggcagcggcaaggagagcagcgccaccagcggcccccaccccgugagcaacaagccccccaccccccccgccaagacccagggccccaccgagaacaacagccacaacgccaccgagcaccccgagccccugacccagagcgccacccugggccugaugaccagccccacccagaucgugcacccccagagcgccaccagcaucaccgugcaggacaccuaccccagccccaccaacagaagcaagagaaaccuggagauggagaucauccugacccugagccagggccugaagaaguacuacggcaagauccugagacugcugagacugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucaagacccccggcacccugagcaccaccgagagcacccccgccgagcugcccaccgccgagcccuucaagagcuacuucgccaagggcuuccugagcaucgacagcggcuacuacagcgccaagugcuacagcggcaccagcaacagcggccugcagcugaucaacaucaccagacacagcgccagaaucguggacacccccggccccaaggugaccaaccugaagaccaucaacugcaucaaccugaaggccagcaucuucaaggagcacagagagguggagaucaacgugcugcugccccagguggccgugaaccugagcaacugccacgugaucaucaagagccacgugugcgacuacagccuggacaucgacggcaccgugagacugccccacaucuaccacgagggcguguucauccccggcaccuacaagaucgugaucgacaagaaggacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagaccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccaucagccugagccccgugcagagcgcccccaucagccacggcaagaccaucgaggccuacagagccagagagggcuacaccagcaucugccuguucgugcugggcagcauccuguucaucgugagcuaccugaugaagggccugguggacagcgugggcaacagcuucuuccccggccugagcaucugcaagaccugcagcaccagcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagaagaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagauccuggccgacagaagaaucgccgagcuguucagcaccaagacccacaucggcuga

SEQ ID NO: 8712 - RNA, 5055 nt, Artificial Sequence
  derived and/or modified CDS sequence (opt4) from CCHFV(UCCR4401)__KY484035.1__GP
augcacaucagccugauguacgccauccugugccugcagcugugcggccugggcgagacccacggcagccacaacgagaccagacacaacaagaccgacaccaugaccacccccggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacagcaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggcuga

SEQ ID NO: 8713 - RNA, 5055 nt, Artificial Sequence
  derived and/or modified CDS sequence (opt4) from CCHFV(IbAn7620)__KX013451.1__GP
augcacaucagccugaucuacgccauccugugccugcagcugugcggccugggcgagaccuacggcagccacaacgagaccagacacaacaagaccgacaccaugaccacccccggcgacaaccugagcagcgagccccccgugagcaccgcccuguucaucacccccgaccccagcaccgugacccccaccacccccgccagcggccuggagggcagcggcgagguguacaccagcccccccaucaccaccggcagccugccccugcccgagaccacccccgagcugcccgccaccaccggcaccgacaccagcagcgccagcgacguggacuucagcacccagaccgccggcggcaccagcgcccugaccgugagaaccggccugcccgacagccccagcacccccagcaccccccaggacacccaccaccccaugagaaaccugcugagcgugaccagccccggccccgacgagaccagcacccccagcggcaccggcagagagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaccauccacccccagagcgccacccccaucaccgugcaggacaagcagcccagccccaccaacagaagcaagagaaaccuggagauggagaucauccugacccugagccagggccugaagaaguacuacggcaagauccugagacugcugcaccugacccuggaggaggacaccgagggccugcuggaguggugcaagagaaaccugggccuggacugcgacgacaacuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugagaaucacccaggagggcagaggccacgugaagcugagcagaggcagcgagaucgugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaccgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaacccccugaacagcaccagccuggagaccagccugagcaucgaggcccccuggggcgccaucgacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccaacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8714 - RNA, 5055 nt, Artificial Sequence
  derived and/or modified CDS sequence (opt4) from CCHFV(Zahedan 2007)__KC867273.1__GP
augcacaucagccugauguacgccguguucugccugcagcugugcggccugggcaagaccaacggcccccacaacggcaccgagcacaacaacacccacgugaugaccacccccgacgacagccagagccccgagccccccgugagcaccgcccugcccgugacccccgaccccagcaccgugacccccagcacccccgccagcggccuggagggcagcggcgaggugcacaccagcagccccaucaccaccaagggccugagccugcccgaggccaccagcgagccccccagcaccaccagcguggugaccagcagcgccagcgacaccgacagcagcacccaggccgccggcgacacccccacccccaccgugagaaccagccugcccagcagccccagcacccccagcaccagccagggcacccacuaccccgugagaagccugcugagcgugaccggccccaagcccgaggagacccccacccccagcaagagcggcaaggacaaccuggccaccaacagcccccaccccgccaccagcagacccaccacccccagcaccaucgcccagaagcccaccgagaacaacagccacaacaccaccgagcagcuggagagccugacccaccuggccacccugggcagcaagaucagccccacccagaccgugcugccccagagcgugaccagcaucgccauccaggacauccacaccagccccaccaacagaagcaagagaaaccuggacauggagaucauccugacccugagccagggccugaagaaguacuacggcaagauccugaagcugcugagacugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccugggcacccugagcaccaccgagagcacccacgccggcagccccaccguggagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucaacugcaucaaccugaaggccagcguguucaaggagcacagagagguggagaucaacgugcugcugccccagguggccgugaaccugagcaacugccacguggccaucaagagccacaucugcgacuacagccuggacaccgacggcgccaucagacugccccagauccaccacgagggcaccuucauccccggcaccuacaagaucgugaucgacaagaagagcaagcugaacgacagaugcacccuguucaccaacugcgugaucaagggcagagaggugagaaagggccagagcgugcugagacaguacaagaccgagaucagaaucggcagagccagcaccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuucugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacagaugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggugcuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaaggacaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugaucuucuucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8715 - RNA, 5055 nt, Artificial Sequence
  derived and/or modified CDS sequence (opt4) from CCHFV(Afg09-2990)__HM452306.1__GP
augcacaucagccugauguacgccguguucugccugcagcugugcggccugggcaagaccaacggcccccacaacggcaccgagcacaacaacacccacgugaugaccacccccgacgacagccagagccccgagccccccgugagcaccgcccugcccgugacccccgaccccagcaccgugacccccagcacccccgccagcggccuggagggcagcggcgagguguacaccagcagccccaucaccaccaagggccugagccugcccgaggccaccagcgagccccccgccaccaccagcguggugaccagcagcgccagcgacaccgacagcagcacccaggccgccggcgacacccccacccccaccgugagaaccagccugcccagcagccccagcacccccagcaccagccagggcacccacuaccccgugagaagccugcugagcgugaccagccccaagcccgaggagacccccacccccagcaagagcggcaaggacaaccuggccaccaacagcccccaccccgccaccagcagacccaccaccccccccaccaccgcccagaagcccaccgagaacaacagccacaacaccaccgagcagcuggagagccugacccaccuggccacccugggcagcaugaucagccccacccagaccgugcugccccagagcgugaccagcaucgccauccaggacauccacaacagccccaccaacagaagcaagagaaaccuggacauggagaucauccugacccugagccagggccugaagaaguacuacggcaagauccugaagcugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccugggcacccugagcaccaccgagagcacccacgccggcagccccaccguggagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucaacugcaugaaccugaaggccagcguguucaaggagcacagagagguggagaucaacgugcugcugccccagguggccgugaaccugagcaacugccacguggccaucaagagccacaucugcgacuacagccuggacaccgacggcgccaucagacugccccagauccaccacgagggcaccuucauccccggcaccuacaagaucgugaucgacaagaagagcaagcugaacgacagaugcacccuguucaccaacugcgugaucaagggcagagaggugagaaagggccagagcgugcugagacaguacaagaccgagaucagaaucggcagagccagcgccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuaccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacaagugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8716 - RNA, 5055 nt, Artificial Sequence
  derived and/or modified CDS sequence (opt4) from CCHFV(SPU41/84)__AY900142.1__GP
augcacaucagccugauguacgccgugcugugccugcagcugugcggccugggcgagacccacggcagccacaacggcaccagauacaacaacaccgacgccaccaccacccccggcgacagccagagccccgagccccccgugagcaccgccagcagcaucacccacaaccccagcaccgugaccagcaccacccccaccagcggcagcgagggcagcggcgagguguacaccagcagccccaucaccaccgagggccugagcccccccggcaccacccccgagcugcccgccaccaccggcaucgacaccagcggcgccagcgacgccaaccccagcacccaggccgccagaggcaccagcgcccugaccgugcacaccagccugcccagcagccccagcaccccccccaucagccaggacacccaccaccccgugagaaaccugcugagcgugaccagccccaugcccgaggagaccaccgcccccagcggcagcggcaaggagagcagcgccaccagcagcccccaccccgccagcgacagaccccccaccccccccgccaccgcccagggccugaccgagagcaacagccacaacgccaccgagcaccuggagagccugacccagagcgccacccccggccuggugaccagccccgcccagaccgugcacccccacagcgccaccagcaucgccgcccccgacacccaccccaaccccaccaacagaagcaagagaaaccuggagauggagaucauccugacccugagccagggccugaagaaguacuacggcaagauccugagacugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcaccgugagcaccaccgagagcacccacgccggcccccccaccgccgagcccuucaagagcuacuucgccaagggcagccugagcaucgacagcggcuacuacagcgccaagugcuacagcggcaccagcaacagcggccugcagcugaucaacaucaccagacacagcaccaagaucgccgacacccccggccccaagaucaccaaccugaagaccaucaacugcaucaaccugaaggcccugaccuucaaggagcacagagagguggagaucaacgugcugcugccccagguggccgugaaccugagcaacugccacguggugaucaagagccacgugugcgacuacagccuggacaucgacggcaccgugagacugccccacauccaccacgagggcaucuucauccccggcaccuacaagaucgugaucgacaagaagaacaagaugaacgacagaugcacccuguucaccaacugcgugaucaagggcagagaggugagaaagggccagagcgugcugaagcaguacaagaccgagaucagaaucggcaaggccagcaccggcagcagaagacugcugagcgaggagagcagcgacgacugcaucagcagaacccagcugcugagaaccgagaccgccgagauccacggcgacaacuacggcggccccggcgacaagaucaccaucugcaacggcagcaccgugguggaccagagacugggcagcgagcugggcugcuacaccaucaacagagugaagaccuucaagcugugcgagaacagcgccaccggcaagagcugcgagaucgacagcgugcccgugaagugcagacagggcuacugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucaucugcaaggugaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagccacggcaagaccguggaggccuacagagccagagagggcuacaccagcaugugccuguucgugcugggcagcgugcuguuccuggugagcugccugaugaagggccugguggacagcgugggcaacaccuucuuccccggccugagcaucugcaagaccugcagcaucagcagcaucaacggcuucgagaucgagagccacagaugcuacugcagccuguucugcugccccuacugcagacacugcagcgccaacaaggagauccaccagcugcaccugagcaucugcaagaagagaaaggccggcagcaacgugaugcuggccgugugcaagagaaugugcuucagagccaccauggaggugagcaacagagcccuguucaucagaagcaucaucaacaccaccuucgugcugugcauccugauccuggccgccugcguggugagcaccagcgccguggagauggagagccugcccgccggcaccugggagagagaggaggaccugaccaacuucugccaccaggagugccagguggccgacaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccuggugcacaagaucgagccccacuucaacaccagcuggaugagcugggacggcugcgaccuggacuacuacugcaacaugggcgacuggcccagcugcaccuacaccggcgugacccagcacaaccacgccagcuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucaccagccugaccugcaccggcugcuacgccugcagcagcggcaucagcugcaaggugagaauccacguggacgagcccgacgagcugaccgugcacgugaagagcgaggaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagagaaagggcaccaucaucggcaagcagaacaacaccugcaaggccaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaagaaucgccgagcuguucagcaccaagacccacaucggcuga

SEQ ID NO: 8717 - RNA, 5055 nt, Artificial Sequence
  derived and/or modified CDS sequence (opt4) from CCHFV(SPU103/87)__DQ211634.1__GP
augcacaucagccugauguacgccgugcugugccugcagcugugcggccugggcggcgcccacggcagccacaacggcaccagauacaacaacaccggcgcccugaccacccugggcgacggccagagcagcgagccccccgugagcaccgcccccagcaccacccacaaccccagcaccgugaccagcaccacccccgccagcggcagcgagggcagcggcgagguguacaccgccagccccgugaccaccgagggccugagcccccccggcaccacccccgagcugcccgccaccaccggcaucgacaccagcggcgccagcgacgccgaccccagcacccaggccgccggcgacaccagcgcccugaccgugagaaccagccugcccagcagccccagcacccugcccaccagccaggacacccaccaccccgugagaaaccugcugagcgugaccagccccagacccgaggagaccaccgcccccagcggcagcggcaucgagagcagcgccaccagcagcccccaccccgccagcgacagaccccccaccccccccgccgccgcccagggccccaccgagagcaacagccacaacgccaccgagcaccuggagagccugacccagagcgccacccccgaccuggugaccagccccgcccagaccgugcacccccagagcgccaccagcaucgccgcccccgacacccaccccagccccaccaacagaagcaagagaaaccuggagguggagaucauccugacccugagccagggccugaagaaguacuacggcaagauccugagacugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcaccgugagcaccaccgagagcacccacgccggcccccccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucgccgacacccccggccccaagaucaccaaccugaagaccaucaacugcaucaaccugaaggcccugaccuucaaggagcacagagagguggagaucaacgugcugcugccccagguggccgugaaccugagcaacugccacguggugaucaagagccacgugugcgacuacagccuggacaucgacggcaccgugagacugccccacauccaccacgagggcaucuucauccccggcaccuacaagaucgugaucgacaagaagaacaagcugaacgacagaugcacccuguucaccgacugcgugaucaagggcagagaggugagaaagggccagagcgugcugaagcaguacaagaccgagaucagaaucggcaaggccagcaccggcagcagaagacugcugagcgaggagagcagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagaccuucaagcugugcgagaacagcgccaccggcaagagcugcgagaucgacagcgugcccgugaagugcagacagggcuacugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcgugcugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaagacugcugcaggugagcgagagcaccggcguggcccugaagagaagcagcuggcugaucgugcugcuggugcuguucaccgugagccugagccccgugcagagcgcccccaucagccacggcaagaccguggaggccuaccaggccagagagggcuacaccggcaugugccuguucgugcugggcagcauccuguuccuggugagcugccugaugaagggccugguggacagcgugggcaacaccuucuuccccggccugagcaucugcaagaccugcagcaucagcagcaucaacggcuucgagaucgagagccacagaugcuacugcagccuguucugcugccccuacugcagacacugcagcgccaacaaggagauccaccagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgacaccgagugccugugccccuacgaggcccuggugcugagaagaccccuguuccuggacaacaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagaucgaguacaucaagaccgaggccaucgugugcguggagcugaccagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccuggugcacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucaccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagcacaagggcaccaucaucggcaagcagaacaacaccugcaaggccagagccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaagaaucgccgagcuguucagcaccaagacccacaucggcuga

SEQ ID NO: 8718 - RNA, 5055 nt, Artificial Sequence
  derived and/or modified CDS sequence (opt4) from CCHFV(Iran-53)__DQ446216.1__GP
augcacaucagccugauguacgccguguucugccugcagcugugcggccugggcaagaccaacggcccccacaacggcaccgagcacaacaacacccacgugaugaccacccccgacgacagccagagccccgagccccccgugagcaccgcccugcccgugacccccgaccccagcaccgugacccccagcacccccgccagcggccuggagggcagcggcgagguguacaccagcagccccaucaccaccaagggccugagccugcccgaggccaccagcgagccccccgccaccaccagcguggugaccagcagcgccagcgacaccgacagcagcacccaggccgccggcggcacccccacccccaccgugagaaccagccugcccagcagccccagcacccccagcaccagccagggcacccacuaccccgugagaagccugcugagcgugaccagccccaagcccgaggagacccccacccccagcaagagcggcaaggacaaccuggccaccaacagcccccaccccgccaccagcagacccaccgccccccccaccaccgcccagaagcccaccgagaacaacagccacaacaccaccgagcagcuggagagccugacccaccuggccacccugggcagcaugaucagccccacccagaccgugcugccccagagcgugaccagcaucgccauccaggacauccacaccagccccaccaacagaagcaagagaaaccuggacguggagaucauccugacccugagccagggccugaagaaguacuacggcaagauccugaagcugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccugggcacccugagcaccaccgagagcacccacgccggcagccccaccguggagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucaacugcaucaaccugaaggccagcguguucaaggagcacagagagguggagaucaacgugcugcugccccagguggccgugaaccugagcaacugccacguggccaucaagagccacaucugcgacuacagccuggacaccgacggcgccaucagacugccccagauccaccacgagggcaccuucauccccggcaccuacaagaucgugaucgacaagaagagcaagcugaacgacagaugcacccuguucaccaacugcgugaucaagggcagagaggugagaaagggccagagcgugcugagacaguacaagaccgagaucagaaucggcagagccagcaccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacaagugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8719 - RNA, 5055 nt, Artificial Sequence
  derived and/or modified CDS sequence (opt4) from CCHFV(Iran-52)__DQ446215.1__GP
augcacaucagccugauguacgccguguucugccugcagcugugcggccugggcaagaccaacggcccccacaacggcaccgagcacaacaacacccacgugaugaccacccccgacgacagccagagccccgagccccccgugagcaccgcccugcccgugacccccgaccccagcaccgugacccccagcacccccgccagcggccuggagggcagcggcgagguguacaccagcagccccaucaccaccaagggccugagccugcccgaggccaccagcgagccccccgccaccaccagcguggugaccagcagcgccagcgacaccgacagcagcacccaggccgccggcgacacccccacccccaccgugagaaccagccugcccagcagccccagcacccccagcaccagccagggcacccacuaccccgugagaagccugcugagcgugaccagccccaagcccgaggagacccccacccccagcaagagcggcaaggacgaccuggccaccaacagcccccaccccgccaccagcagacccaccaccccccccaccaccgcccagaagcccaccgagaacaacagccacaacaccaccgagcagcuggagagccugacccaccuggccacccugggccugaugaucagccccacccagaccgugcugccccagagcgugaccagcaucgccauccaggacauccacaacagccccaccaacagaagcaagagaaaccuggacauggagaucauccugacccugagccagggccugaagaaguacuacggcaagauccugaagcugcugcaccugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccugggcacccugagcaccaccgagagcacccacgccggcagccccaccguggagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucaacugcaugaaccugaaggccagcguguucaaggagcacagagagguggagaucaacgugcugcugccccagguggccgugaaccugagcaacugccacguggccaucaagagccacaucugcgacuacagccuggacaccgacggcgccaucagacugccccagauccaccacgagggcaccuucauccccggcaccuacaagaucgugaucgacaagaagagcaagcugaacgacagaugcacccuguucaccaacugcgugaucaagggcagagaggugagaaagggccagagcgugcugagacaguacaagaccgagaucagaaucggcagagccagcaccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacaagugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggaggagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8720 - RNA, 5055 nt, Artificial Sequence
  derived and/or modified CDS sequence (opt4) from CCHFV(75024)__AB069671.1__GP
augcacaucagccugaugugcgccgugcugugccugcagcuguacggccugggcgagacccacggcagcagcaacgagaccgagcacaacaagaccaacguggugaccacccccggcgacagccagagccccgagccccuggugagcaccacccugcccgugacccuggacagcagcaccgugacccccaccacccccgccagcggccccgagggcagcggcgagguguacaccagcccccccaucaccaccgagggccugagccccagcgaggccaccagcgagcugcccgccaccaccggcaucggcaucagcagcgccagcgacguggacagcagcacccaggccgccggcgacaccagcacccccaccgugagaaccagcccccccaacagcagcagcaccccccccaccagccaggacacccaccaccccaugagaaaccugcugagcgugaccagccugaagcccgaggagaccagcgcccccagcaagagcggcaaggagagccccgccgccagcagcccccaccccguggccagcagaccccccaccccccccaccaccgcccagggccccaucgagaacaacagccacaacaccaccggccagcuggagagcgugacccagagcgccacccugggccccauggccagccccacccagaccgugcugagccagaacgugaccagcaucgccauccaggacacccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccgagagccccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugagacugccccacauccaccacgagggcaccuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucggccacggcaagaccaucgagaccuaccaggccagagaggaguacaccagcaucugccuguucgugcugggcagcauccuguucaucgugagcugccugaugaagggccugguggacagcaucggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugagaggcaugaagaaccagcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaaccuguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8721 - RNA, 5055 nt, Artificial Sequence
  derived and/or modified CDS sequence (opt4) from CCHFV(7803)__AB069672.1__GP
augcacaucagccugaugugcgccgugcugugccugcagcuguacggccugggcgagacccacggcagcagcaacgagaccgagcacaacaagaccaacguggugaccacccccggcgacagccagagccccgagccccuggugagcaccacccugcccgugacccuggacagcagcaccgugacccccaccacccccgccagcgagcccgagggcagcggcgagguguacaccagcccccccaucaccaccgagggccugagccccagcgaggccaccagcgagcugcccgugaccaccggcaucggcaucagcagcgccagcgacguggacagcagcacccaggccgccggcgacaccagcacccccaccgugagaaccagcccccccaacagccccagcaccccccccaccagccaggacacccaccaccccaugagaaaccugcugagcgugaccagccugaagagcgaggagaccagcgcccccagcaagagcggcaaggagagccccgccgccagcagcccccaccccguggccagcagaccccccacccaccccaucaccgcccagggccccaccgagaacaacagccacaacaccaccggccagcuggagagcgugacccagagcgccacccugggccccauggccagccccacccagaccgugcugagccagaacgugaccagcaucgccauccaggacacccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccgagagccccaccgccgagcccuucaagagcuacuucgccaagggcuuccugagcaucgacagcggcuacuucagcgccaagugcuacagcagaaccagcgacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugagacugccccacauccaccacgagggcaccuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgaggugauccuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucagccacggcaagaccaucgagaccuaccaggccagagaggaguacaccagcaucugccuguucgugcugggcagcauccuguucaucgugagcugccugaugaagggccugguggacagcaucggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgccugcaagagaaugugcuucagagccaccauggaggugagcaacaaggcccugcugaucagaagcaucaucaacaccaccuucgugguguacauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugagaggcaugaagaacccccugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccagaggcaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8722 - RNA, 5055 nt, Artificial Sequence
  derived and/or modified CDS sequence (opt4) from CCHFV(Hodzha)__AY223476.1__GP
augcacauccugcugaugugcgccgugcugugccugcagcaguacggccugggcgagacccacagacccaacaacggcaccgagcacaacaagaccaacgugcugaccacccccggcgacaagcugagccccgagcugcccgugagcaccgcccugagcgugacccccgacagcagcaccgugacccccaccacccccgugagcggccuggagggcagcggcgacguguacaccagcccccccgugaccaccaagggccugagccccagcaaggccaccagcgagcugcccgccagcagcggcaucgacaccagcagcgccagcgacguggacagcagcacccaggccgccagagacaccagcacccugaccgugagaaccagcccccccagcagccccagcaccccccccaccagccaggacaccuaccaccuggugagaaaccugcugagcgugaccagccccuggcccgaggagaccaccgcccccagcaagagcggcaaggagagccccguggccaacagcccccaccccgugaccagcagacccagcagcccccccaucaccgugcagggccccaccgagaacagcagccacaacaccaccggccagcuggagagcauggcccagagcaccacccuggugcccauggccagccccacccagaccgugcugagccagagcgugaccagccuggccgugcaggacgcccaccccagccccaccaacagaagcaagagaaaccuggagauggugaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucaagacccccagcacccugagcaccaccgagagcacccacgccgugagccccaccgccgagcccuucaagagcuacuucgccaagggcuuccugagcaucgacagcggcuacuucagcgccaagugcuacagcaagaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacguggacggcaccgugagacugccccacauccaccacggcggcaccuucauccccggcaccuacaagaucgugaucgacaagaagaacaagcugaacgacagaugcacccuguacaccaacugcgugaucaagggcagagaggugagaaagggccagagcauccugagacaguacaagaccgagaucagaaucggcaaggccagcaccggcagcagaagacugcugagcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcaagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggccagagaggacuacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagagaaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8723 - RNA, 5055 nt, Artificial Sequence
  derived and/or modified CDS sequence (opt4) from CCHFV(Hodzha)__KX013448.1__GP
augcacauccugcugaugugcgccgugcugugccugcagcaguacggccugggcgagacccacagacccaacaacggcaccgagcacaacaagaccaacgugcugaccacccccagcgacaagcugagccccgagccccccgugagcaccgcccugagcgugacccccgacagcagcaccgugacccccaccacccccgugagcggccuggagggcagcggcgagguguacaccagcccccccgugaccaccaagggccugagccccagcaaggccaccagcgagcugcccgccaccaccggcaucgacaccagcagcgccagcgacguggacagcagcacccaggccgccagagacaccagcacccugaccgugagaaccagcccccccagcagccccagcaccccccccaccagccaggacaccuaccaccuggugagaaaccugcugagcgugaccagccccagacccgaggagaccaccgcccccagcaagagcggcaaggagagccccguggccaacagcccccaccccgugaccagcagacccagcagcccccccaucaccgugcagggccccaccgagaacagcagccacaacaccaccggccagcuggagagcauggcccagagcaccacccuggugcccauggccagccccacccagaccgugcugagccagagcgugaccagccuggccgugcaggacgcccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucaagacccccagcacccugagcaccaccgagagcacccacgccgugagccccaccgccgagcccuucaagagcuacuucgccaagggcuuccugagcaucgacagcggcuacuucagcgccaagugcuacagcaagaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacguggacggcaccgugagacugccccacauccaccacggcggcaccuucauccccggcaccuacaagaucgugaucgacaagaagaacaagcugaacgacagaugcacccuguacaccaacugcgugaucaagggcagagaggugagaaagggccagagcauccugagacaguacaagaccgagaucagaaucggcaaggccagcaccggcagcagaagacugcugagcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccgagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggccagagaggaguacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugccccgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaagaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugcagcgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcagaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8724 - RNA, 5055 nt, Artificial Sequence
  derived and/or modified CDS sequence (opt4) from CCHFV(Baghdad 12)__AJ538197.2__GP
augcacaucagccugaucuacgccgugcugugccugcagcuguacggccugggcgagacccacggcagcagcagcggcaccgagcacaacagaaccaacgugguggccacccccggcggcagccagagccccgagccccuggugagcaccacccugcccgugacccuggacagcagcaccgugacccccgccacccaggccagcggccccgagggcagcggcgagguguacaccagcccccccaccaccaccgagggccugagccccagcgacgccaccagcgagcugcccaccaccaccggcaucggcaucagcagcagcagcgacgugaacagcagcacccaggccgccggcgacaccagcacccccaccgccagaaccagccugcccgacagccccagcaccccccccaccagccaggacacccaccaccccaugagaaaccugcugagcgugaccagccugaagcccgaggagacccccgcccccagcaagagcggcaaggagagccccgccgccagcagcccccaccccguggccagcagaccccccacccccagcaccaccgcccagggccccaccgagaacaacagcagaaacaccaccgugcagcugaagagcgugacccagagcgccacccugggccccauggccagccccacccagaccgugcugcugcagagcgugaccagcaucgccauccaggacacccaccccagccccaccaacagaagcagaagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccggcagccccaccguggagcccuucaagagcuacuucgccaagggcuuccugcugaucgacagcggcuacuucagcgccaagugcuacagcagaaccagcaacagcggccugcagcugaucaacgugaccagacacagcaccaagaucgccgacacccccggccccaagaucaccaaccugaagaccaucagcugcaucaaccugaaggccagcaucuucaaggagcacagagagaucgagaucaacgugcugcugccccagguggccgugaaccugagcaacugccacgugaccaucaagagccacgugugcgacuacagccugaacaucgacggcaccgugaagcugccccacauccaccacgagggcaucuucauccccggcaccuacaagaucgugaucgacaagaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgaggagagcggcgacgacugcaucagcagaaccagacugcugagaaccgagaccgccgagauccacggcgacagcuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcaagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcuggccgugagcagcagccccgugcagagcgcccccaucggcuacggcaagaccaucgagaccuaccaggccagagagggcuacaccagcaucugccuguucgugcugggcagcauccuguucaucgugagcugccugaccaagggccugguggacagcaucggcaacaucuucuuccccggccugagcaucugcaagaccugcagcaucggcagcaucaacggcuucgagguggagagccacaagugcuacugcagccugcugugcugccccuacugcagacacugcagcgccgacagagagauccaccagcugcaccugagcaucugcaagaagagaaagaccggcagcagcgugaugcuggccgugugcaagagaaugugcuucagagccaccauggaggugagcaacaaggcccugcugaucagaagcaucaucaacaccaccuucguggugugcauccugacccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgacgccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggugagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8725 - RNA, 5055 nt, Artificial Sequence
  derived and/or modified CDS sequence (opt4) from CCHFV(TADJ/HU8966 )__AY179962.1__GP
augcacaugcugcugaugugcgccgugcugugccugcagcuguacggccugggcggcacccugagaagcaacaacggcaccgagcacaacaagaccaacgugcugaccacccccggcgacaagcugagccccgagccccccgugagcaccgcccugcccgugacccccgacagcagcaccgugacccccaccacccccgccagcggccuggagggcagcggcgagguguacaccagcccccccaucaccaccaagggccugagccccagcgaggccaccagcgagccccccgccaccaccggcaugggcaucagcagcgccagcggcguggacuucagcacccaggccgccagagacaccagcacccugaccgugcugaccagcccccccaacagccccaacaccccccccaccagccaggacacccaccaccccgugagaagccugcugagcgugaccagccccagacccgaggagaccaccgcccccagcaagagcggcaaggagagccccgccgccaacagcagccaccccgugaccagcagacccagcagcccccugaucaccgugagaggccccaccgagaacagcagccacaacaccaccggccagcuggagagcaugacccagagcaccacccuggugcccauggccagccccacccagaccgugcugagccagagcgugaccagcaucgccgugcaggacgcccaccccagcagcaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccggcagccccaccgccgagcccuucaagagcuacuucgccaagggcuuccugagcaucgacagcggcuacuucagcgccaagugcuacagcagaaccagcaacagcggccugagacugaucaacgugaccagacacagcaccagaaucgccgacacccccggccccaagaucaccaaccugaagaccaucagcugcaucaaccugagagccagcaucuucaaggagcacagagagguggagaucaacgugcugcugccccagguggccgugaaccugagcaacugccacguggccaucaagagccacgugugcgacuacagccuggacguggacggcaccgugagacugccccacauccaccacggcggcaccuucauccccggcaccuacaagaucgugaucgacaagaagaacaagcugaacgacagaugcacccuguucaccaacugcgugaucaagggcagagaggugagaaagggccagagcauccugagacaguacaagaccgagaucagaaucggcaaggccagcaccggcagcagaagacugcugagcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugaagaucacccaggagggcagaggccacgugaagcugagcagaggcagcgagguggugcuggacgccugcgacagcagcugcgaggugaugauccccaagggcaccggcgacaucagcguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccagaauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagagaguggaggagaccgagcuguaccugaaccuggagagaauccccuggaucgugagaaagcugcugcaggugagcgagagcaccggcguggcccugaagagaagcagcuggcugaucgugcugcuggugcuguucaccgugagccugagccccgugcagagcgcccccaucggcuacggcaacaccaucgagaccuaccaggccagagaggaguacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaacccccugaacagcaccagccuggagaccagccugagcaucgaggcccccuggggcgccaucaacgugcagagcaccuacaagcccaccgugagcaccgccaacaucgcccugagcuggagcagcaucgagcacagaggcaacaacauccuggugagcggcagaagcgagagcaucaugaagcuggaggagagaaccggcaucagcggcgaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaucgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggagaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacagaaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccugagcugcuucaagugcugcagaagaaccagaggccugcugaagcacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8726 - RNA, 5055 nt, Artificial Sequence
  derived and/or modified CDS sequence (opt4) from CCHFV(K168_40)__KX013457.1__GP
augcacaucagccugaugugcgccgugcugugccugcagcuguacggccugggcggcacccacggccugcacaacggcaccgagcacaacaagaccaacgccgugaccaccagcagcaacagccagagcagcgagagccccgccagaaccgccccccccgugacccccgacagccccaccgugacccccaccacccccgccagcgcccccgagggcagcggcgaggcccacagcagcccccccaacaacaccgagggccccagccugcccgagagcaccagcgagccccccgccgccaccagcaccggcauccccagcgccagcgacgugaacagcagcacccaggccgccagagacaccagcacccccaccgugagaaccagcccccccaacagccccagcaccccccccaccccccaggagacccaccaccccgugagaaaccugcugagcgugaccagccacaagcccgaggagaccagcgcccccagcgagagcggcaaggagagccccgccgccaacagcccccaccccguggccagcagaccccccacccccagcaccaccgcccagggccccaccgagaacaacaacuacaacaccaccggccagcuggagagccugacccagagcaccacccugggccccaugaccagccugacccagaccgaccugccccagagcgugaccagcaucgccgugcaggacacccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccggccugcccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugagacugccccacauccaccacgacggcaccuucauccccggcaccuacaagaucgugaucgacagaaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccguggaggugagcaacaaggcccugagcaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacggcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8727 - RNA, 5055 nt, Artificial Sequence
  derived and/or modified CDS sequence (opt4) from CCHFV(K128_76)__KX013454.1__GP
augcacaucagccugaugugcgccgugcugugccugcagcuguacggccugggcggcacccacggcagccacaacgagaccgagcacaacaagaccaacgccgugaccaccagcagcgacagccagagccccgagccccccaccagaaccacccugcccgugacccccgacagccccaccgugacccccaccacccccgccagcgcccccgagggcagcggcgaggugcacaccagcccccccaacaccaccgagggccccagccugcccgagagcacccccgagccccccaccgccaccagcaccggcauccccagcgccagcgacgugaacagcagcacccaggccgccagagacaccagcacccccaccgugcacaccagcccccccaacagccccagcaccccccccacccugcaggagacccaccaccccaugagaaaccugcugagcgugaccagccacaagcccgaggagaccagcgcccccagcgagagcggcaaggagagccccgccgccaacagcccccaccccguggccgacagacccagcaccagcagcaccaccgcccagggccccaccgagaacaacagcuacaacaccaccgagcagcuggagagccugacccagagcaccacccugggccccaugaccagccugacccagaccgugcugagccagagcgugaccagcaucgccgugcaggacacccaccugagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccuggaccuggacugcgacgacaccuucuuccagaagagaaucgaggaguucuucaucaccggcgagggcuacuucaacgaggugcugcaguucagaacccccggcacccugagcaccaccgagagcacccacgccggccugcccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccccaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugaagcugccccacauccaccacgacggcaccuucauccccggcaccuacaagaucgugaucgacagaaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucagccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccaggacagcaucgugaagggcaugaagaaccugcugaacagcaccagccuggagaccagccugagcaucgaggcccccuggggcgccaucaacgugcagagcaccuacaagcccgccgugagcgccgccaacaucgcccugagcuggagcagcguggagcacagaggcagcaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggagaacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8728 - RNA, 5055 nt, Artificial Sequence
  derived and/or modified CDS sequence (opt4) from CCHFV(K168_125)__KX013460.1__GP
augcacaucagccugaugugcgccgugcugugccugcagcuguacggccugggcggcacccacggccugcacaacggcaccgagcacaacaagaccaacgccgugaccaccagcagcaacagccagagcagcgagagccccgccagaaccgccccccccgugacccccgacagccccaccgugacccccaccacccccgccagcgcccccgagggcagcggcgaggcccacagcagcccccccaacaacaccgagggccccagccugcccgagagcaccagcgagccccccgccgccaccagcaccggcauccccagcgccagcgacgugaacagcagcacccaggccgccagagacaccagcacccccaccgugagaaccagcccccccaacagccccagcaccccccccaccccccaggagacccaccaccccgugagaaaccugcugagcgugaccagccacaagcccgaggagaccagcgcccccagcgagagcggcaaggagagccccgccgccaacagcccccaccccguggccagcagaccccccacccccagcaccaccgcccagggccccaccgagaacaacaacuacaacaccaccggccagcuggagagccugacccagagcaccacccugggccccaugaccagccugacccagaccgaccugccccagagcgugaccagcaucgccgugcaggacacccaccccagccccaccaacagaagcaagagaaaccuggagauggagaucauccugacccugccccagggccugaagaaguacuacggcaaggugcugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccacgccggccugcccaccgccgagcccuucaagagcuacuucgccaagggcuuccugagcaucgacagcggcuacuucagcgccaagugcuacagcagaaccagcaacagcggccugcagcugaucaacgugaccagacacagcaccagaaucgccgacacccccggccugaagaucaccaaccugaagaccaucagcugcaucaaccugaaggccagcguguucaaggagcacagagagguggagaucaacgugcugcugccccagguggccgugaaccugagcaacugccacgugaccaucaagagccacgugugcgacuacagccuggacaucgacggcaccgugagacugccccacauccaccacgacggcaccuucauccccggcaccuacaagaucgugaucgacagaaagaacaagcugaacgacagaugcacccuguucaccaacugcgugaucaagggcagagaggugagaaagggccagagcgugcugagacaguacaagaccgagaucagaaucggcaaggccagcaccggcagcagaagacugcugagcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaaggugccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccguggaggugagcaacaaggcccugagcaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaagaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8729 - RNA, 5052 nt, Artificial Sequence
  derived and/or modified CDS sequence (opt4) from CCHFV(Kosova Hoti)__EU037902.1__GP
augcacacccugcuggugugcuucauccuguaccugcagcugcugggccugggcggcgcccacggccagagcaacgccaccgagcacaacggcaccaacaccaccaccgcccccggcaccagccagagccccaagccccccgccagcaccacccccagccacgcccccgagcccagcaccaucaagcugaccacccccaccagcgagaccgagggcagcggcgagaccaccccccccaccaacaccacccaggacagccccccccuggagaccacccccgagagaagcgccaccaccgccaccagcaccagcggcaccgacaacaugaacagcaccacccagaugaccgacaacacccccaccagcaccgugagcaccagccugagcagcagccccagcacccccagcaccagccagggcaugcaccaccccgugagaagccugcugagcgugagcagccccaagaccgccaccacccccacccccaugagccccggcgagaugagcagcgagaccagcagccagcacagcgccaugagcagaacccccaccccccacaccgccacccaggugagcaccgagaacgccaacagaagcaccagcagacagagcgagagcagcgcccagcccgccacccagagccccgugaccagccccgcccagagcauccugcugaugagcgccacccccaccaccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccccagcagcaccgagcccagccacgccagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucaugcccggcaccuacaagaucgugaucgacagaaagaacaagcugaacgacagaugcacccuggugaccaacugcgugaucaagggcagagaggugagaaagggccagagcgugcugagacaguacaagaccgagaucaagaucggcaaggcccccaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccagaagggcagaggccacgugaagcugagcagaggcagcgagguggugcuggacgccugcgacagcaacugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccaagaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugaacaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugcccccagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8730 - RNA, 5049 nt, Artificial Sequence
  derived and/or modified CDS sequence (opt4) from CCHFV(Oman)__DQ211632.1__GP
augcacacccugcugguguacgccguguucugccugcagcuguggagccccggcggcaccagaggccugagcaacgagacccagcacaacgagaccggcaucaccagagcccccgagggcagccagggccccagccugcccgugagcaccgccagccccaucaugagcgaccccagcaucaccacccccagcgccagcaccagcggccuggagggcagcggcgacaccaccccccccgccaucacccagggccccaccccccccgagaccacccccgagcccagcaccaccaccggcaccaacgccuucagcaccgccaucgccaacgugagcacccagaccgugaaggacacccccacccccaccgugcagaccagcccccccagcacccccgacgccagcaccaucccccagggcacccaccacaccgccagaggccugcugagcgugaccgugaccaagcccgaggaggugcccacccccaccggccccgagcaggccagcaucgagaccaacagccccagacuggccaccagcaagacccccagccccagccccaccgcccaggugaccaccgagaacagcaaccccaacaccagcagacagcuggugcugagcacccagcccgccaccagcagccccgugaccagccccgcccagcugaucuucgugcagagcgccaccaccguggccgugcaggacgcccaccccagccccaccaacagaagcaagagaaaccuggagauggaggugauccugacccugagccagggccugagaaaguacuacggcagaauccugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagcagcaccgagagcgccagcgugggccugcccaccguggagcccuucaagagcuacuucgccaagggcuuccugagcaucgacagcggcuacuucagcgccaagugcuaccccagagccagcaacagcggccugcagcugaucaacgugacccagcacagcgccagaaucgccgacacccccggccccaagaucaccaaccugaagaccaucaacugcaucaaccugaaggcccugguguucaaggagcacagagagaucgagaucaacgugcugcugccccagguggccgugaaccugagcaacugccacgugcacaucaagagccacgugugcgacuacagccuggacaucgacggcaccgugagacugcccagaauccaccacgagggcaccuucauccccggcaccuacaagaucgugaucgacaagaagaacaagcagaacgacagaugcaaccuggugaccaacugcgugaucaagggcagagaggugagaaagggccagagcgugcugagacaguacagaaccgagaucagaaucggcaaggccagcagcggcagcagaagacugcugagcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuucugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8731 - RNA, 5049 nt, Artificial Sequence
  derived and/or modified CDS sequence (opt4) from CCHFV(Oman_812956)__KY362518.1__GP
augcacacccugcugguguacgccguguucugccugcagcuguggagccccggcggcaccagaggccugagcaacgagacccagcacaacgagaccggcaucaccagagcccccgagggcagccagggccccagccugcccgugagcaccgccagccccaucaugagcgaccccagcaucaccacccugagcgccagcaccagcggccuggagggcagcggcgacaccaccccccccgccaucacccagggccccacccugcccgagaccacccccgagcccagcaccaccaccggcaccaacgccuucagcaccgccaucgccaacgugagcacccagaccgugaaggacacccccacccccaccgugcagaccagcccccccagcacccccgacgccagcaccaucccccagggcacccaccacaccgccagaggccugcugagcgugaccgugaccaagcccgaggaggugcccacccccaccggccccgagcaggccagcaucgagaccaacagccccagacuggccaccagcaagacccccagccccagccccaccgcccaggugaccaccgagaacagcaaccccaacaccagcagacagcuggugcugagcacccagcccgccaccagcagccccgugaccagccccgcccagcugaacuucgugcagagcgccaccaccaucgccgugcaggacgcccaccccagccccaccaacagaagcaagagaaaccuggagauggaggugauccugacccugagccagggccugagaaaguacuacggcagaauccugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagagcgccagcgugggccugcccaccguggagcccuucaagagcuacuucgccaagggcuuccugagcaucgacagcggcuacuucagcgccaagugcuaccccagagccagcaacagcggccugcagcugaucaacgugacccagcacagcgccagaaucgccgacacccccggccccaagaucaccaaccugaagaccaucaacugcaucaaccugaaggcccugguguucaaggagcacagagagaucgagaucaacgugcugcugccccagguggccgugaaccugagcaacugccacgugcacaucaagagccacgugugcgacuacagccuggacaucgacggcaccgugagacugcccagaauccaccacgagggcaccuucauccccggcaccuacaagaucgugaucgacaagaagaacaagcagaacgacagaugcaaccuggugaccaacugcgugaucaagggcagagaggugagaaagggccagagcgugcugagacaguacagaaccgagaucagaaucggcaaggccagcagcggcagcagaagacugcugagcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucuucgacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8732 - RNA, 5049 nt, Artificial Sequence
  derived and/or modified CDS sequence (opt4) from CCHFV(Oman-199809166)__KR864901.1__GP
augcacacccugcugguguacgccguguucugccugcagcuguggagccccggcggcaccagaggccugagcaacgagacccagcacaacgagaccggcaucaccagagcccccgagggcagccagggccccagccugcccgugagcaccgccagccccaucaugagcgaccccagcaucaccacccugagcgccagcaccagcggccuggagggcagcggcgacaccaccccccccgccaucacccagggccccacccugcccgagaccacccccgagcccagcaccaccaccggcaccaacgccuucagcaccgccaucgccaacgugagcacccagaccgugaaggacacccccacccccaccgugcagaccagcccccccagcacccccgacgccagcaccaucccccagggcacccaccacaccgccagaggccugcugagcgugaccgugaccaagcccgaggaggugcccacccccaccggccccgagcaggccagcaucgagaccaacagcagcagacuggccaccagcaagacccccagccccagccccaccgcccaggugaccaccgagaacagcaaccccaacaccagcagacagcuggugcugagcacccagcccgccaccagcagccccgugaccagccccgcccagcugaacuucgugcagagcgccaccaccaucgccgugcaggacgcccaccccagccccaccaacagaagcaagagaaaccuggagauggaggugauccugacccugagccagggccugagaaaguacuacggcagaauccugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagagcgccagcgugggccugcccaccguggagcccuucaagagcuacuucgccaagggcuuccugagcaucgacagcggcuacuucagcgccaagugcuaccccagagccagcaacagcggccugcagcugaucaacgugacccagcacagcgccagaaucgccgacacccccggccccaagaucaccaaccugaagaccaucaacugcaucaaccugaaggcccugguguucaaggagcacagagagaucgagaucaacgugcugcugccccagguggccgugaaccugagcaacugccacgugcacaucaagagccacgugugcgacuacagccuggacaucgacggcaccgugagacugcccagaauccaccacgagggcaccuucauccccggcaccuacaagaucgugaucgacaagaagaacaagcagaacgacagaugcaaccuggugaccaacugcgugaucaagggcagagaggugagaaagggccagagcgugcugagacaguacagaaccgagaucagaaucggcaaggccagcagcggcagcagaagacugcugagcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8733 - RNA, 5055 nt, Artificial Sequence
  derived and/or modified CDS sequence (opt4) from CCHFV(BA66019)__AF350448.1__GP
auguacacccugcuggugugcgccgugcugugcccccagcuguggagccuggagggcacccacgugccccacaacgagaccaagcacaacggcaccggcaucaccgccgcccccggcgagagccagggccccaugagccccgccagcaccgccgugccccugacccccgagccccccaacaccaagcccgccgccagcgccagcgagcuggagagcagcggcgagggccacaccagccugcuggccaccacccagggccugaccagccccgaggccacccccgagcugcccaccaccaccgacaccggcgugagcagcaccagcgugguggacaucggcacccagauggccaaggacacccccaccagcaccgcccacaccagccugcccagcaaccccagcgcccccagcaccgcccagggcacccaccacaccaucagaggccugcugagcgugaccagcaccaagcccgaggaggccagcacccccaccgaccccggcaaggccggcgccgagaccggcagccccagacccgccaucagcagaaagcccacccugagccccaccgccgaggcccccaccgagaucaacaacagcagcacccccaagcagcccgagcccagcauccagcccgccacccccagccuggugaucagccccgcccagcccgccuucccccagagcgccaccagcaccgccgcccaggacaucuacagcagccccaccaacagaagcaagagaaaccugaagauggagaucauccugacccugagccagggccugaagaaguacuacggcaagauccagaagacccugggccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaagacccccagcacccccggcagcaccgagcccacccacgccgaggcccccaccgugaagcccuucaagagcuacuucgccagaggcuuccugaccaucaacagcggcuacuucagcgccaagugcuacagcuggaccagcaacagcggccugcagcugaucaacgugacccagcaccccgccagaaucgccgacacccccggccccaagaucaccaaccugaagaccaucaacugcaucaaccugaaggccagcguguucaaggagcacagagagaucgagaucaacgugcugcugccccagguggccgugaaccugagcaacugccacgugcugaucaagagccacgugugcgacuacagccuggacaucgacggcaccaucagacugcccagaaucuaccacgagggcaccuucauccccggcaccuacaagaucgugaucgacaagagagacaagcagaacgacagaugcacccuggugaccaacugcgugaucaagggcagagaggugagaaagggccagagcgcccugagacaguacagaaccgagaucagaaucggcaaggccagcgccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaagcaccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgaggccuaccagaccagagagggcuacaccagcgugugccuguucaugcugggcggcauccuguucguggugagcugccugaugaagggccugguggacagcgugagcaacagcuucuuccccggccugagcaucugcaagaccugcagcaucggcagcgugaacggcuucgagaucgagagccacaagugcuacugcagccugcugugcugccuguacugcagacacugcagcgccgacagagagauccaccagcugcaccugagcaucugcaagaagagaagagccggcggcaacgugaugcuggccgugugcaagagaaugugccugagagccaccauggaggugagcaacaaggugcuguucaucagaagcaucaucaacaccaccuucgugaucugcauccuggugcuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8734 - RNA, 5055 nt, Artificial Sequence
  derived and/or modified CDS sequence (opt4) from CCHFV(SPU 18/88)__KJ682810.1__GP
auguacaccccccugcugugcgccauccugugccugcagcuguggagccuggagggcaucuacggccugagcaacaagacccagcacaacgacaccagcaccaucaaggugcccgaggagagccagaagaccagccugcccgccaacaccgccagccccaucaccagcgaccccagcagcgccaccagcaccgcccuggccagcggccccgagggcagcggcgacaccagcaccagccccagcgugaccacccagggccccacccugcuggagaccacccccgagccccacaccaccaucgacaucgacgagagcagcaccgccaucgccgacaucagcacccagaccgugaaggacauccccacccccaccacccacaccagccugcccagcacccccagcgcccccaccaucccccaggaggcccaccacaccgccagaggccugcugagcgugaccagcaccaagcccggcgagaccagcacccccaccagccccggcgaggccagcaccgaggccagcagcccccagcccaccaucagcgagacccccagccccccccccaccacccaggcccccaccgagaucaacaaccccaacaccagcagacagcccaugcccagcacccagcccgccgcccccaacagcgugaccccccccgugcagcccaccuucagccagagcgacgugagcaccguggcccaggacauccaccccagccccaccaacagaagcaagagaaaccuggagauggagaucauccugacccugagccagggccugaagaaguacuacggcaaggugcugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugagcauggacagcggcuacuucagcgccaagugcuaccccaagagcagcaacagcggccugcagcugaucaacgugacccagcacagcaucagaaucaccgacacccccggccccaagaucaccagccugaagaccaucaacugcaucaaccugaaggcccugguguucaaggagcacagagagaucgagaucaacgugcugcugccccagguggccgugaaccugagcaacugccacgugcugaucaagagccacgccugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugggcuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucagccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccggcaaggccggcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaagaacaagaagggcaagaacaagcugcuggacggcgagagacuggccgacagaaagaucgccgagcuguucagcaccaagacccacaucggcuga

SEQ ID NO: 8735 - RNA, 5055 nt, Artificial Sequence
  derived and/or modified CDS sequence (opt4) from CCHFV(66019)__AB069669.1__GP
auguacacccugcuggugugcgccgugcugugcccccagcuguggagccuggagggcacccacgugccccacaacgagaccaagcacaacggcaccggcaucaccgccgcccccggcgagagccagggccccaugagccccgccagcaccgccgugccccugacccccgagccccccaacaccaagcccgccgccagcgccagcgagcuggagagcagcggcgagggccacaccagccugcuggccaccacccagggccugaccagccccgaggccacccccgagcugcccaccaccaccgacaccggcgugagcagcaccagcgugguggacaucggcacccagauggccaaggacacccccaccagcaccgcccacaccagccugcccagcaaccccagcgcccccagcaccgcccagggcacccaccacaccaucagaggccugcugagcgugaccagcaccaagcccgaggaggccagcacccccaccgaccccggcaaggccggcgccgagaccggcagccccagacccgccaucagcagaaagcccacccugagccccaccgccgaggcccccaccgagaucaacaacagcagcacccccaagcagcccgagcccagcauccagcccgccacccccagccuggugaucagccccgcccagcccgccuucccccagagcgccaccagcaccgccgcccaggacaucuacagcagccccaccaacagaagcaagagaaaccugaagauggagaucauccugacccugagccagggccugaagaaguacuacggcaagauccagaagacccugggccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaagacccccagcacccccggcagcaccgagcccacccacaccgaggcccccaccgugaagcccuucaagagcuacuucgccagaggcuuccugaccaucgacagcggcuacuucagcgccaagugcuacagcagaaccagcaacagcggccugcagcugaucaacgugacccagcaccccgccagaaucgccgacacccccggccccaagaucaccaaccugaagaccaucaacugcaucaaccugaaggccagcguguucaaggagcacagagagaucgagaucaacgugcugcugccccagguggccgugaaccugagcaacugccacgugcugaucaagagccacgugugcgacuacagccuggacaucgacggcaccaucagacugcccagaaucuaccacgagggcaccuucauccccggcaccuacaagaucgugaucgacaagagagacaagcagaacgacagaugcacccuggugaccaacugcgugaucaagggcagagaggugagaagaggccagagcgcccugagacaguacagaaccgagaucagaaucggcaaggccagcgccggcagcagaagacugcugagcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaacacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgaggccuaccagaccagagagggcuacaccagcgugugccuguucaugcugggcggcauccuguucguggugagcugccugaugaagggccugguggacagcgugagcaacagcuucuuccccggccugagcaucugcaagaccugcagcaucggcagcgugaacggcuucgagaucgagagccacaagugcuacugcagccugcugugcugccuguacugcagacacugcagcgccgacagagagauccaccagcugcaccugagcaucugcaagaagagaagagccggcggcaacgugaugcuggccgugugcaagagaaugugccugagagccaccauggaggugagcaacaaggugcuguucaucagaagcaucaucaacaccaccuucgugaucugcauccuggugcuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcaacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8736 - RNA, 5052 nt, Artificial Sequence
  derived and/or modified CDS sequence (opt4) from CCHFV(Gaib)__KX013445.1__GP
auguacaucccccugguguacgccgugaucuaccugcagcuguacggccugggcggcgcccacggccugcugaacaagaccgagcagaacgagaccggcaucaccgccacccacggcagagugcagggcccccccagcgccagcaucacccugcccgugacccccgacccccugagcgccaccagcgccgccagcaccagcggccccgagggcagcggcgaggugcccaccagccccagcaccaucacccagggccugaccagcagcgagaacaccccccagcugcccaccgccaccgacaccggcaucagcagcaccagcaucaucgacgugagcacccagaccgccggcgacaccagcacccccaccgcccacaccagccugcccaacagccccagcgcccccuucaccagccaggacaccagacacaccgugagaggccugcugaccgugaccagcaccaagagcgacgaggccagcacccugaccgaccccaaggaggccagcaccgaggccagaagccccagccccagcaucagcagaacccccacccccagccccaccgugcaggccagcaccgagaacaacacccccagcacccccagacagcccgagcccaccaccagacccgcccugcccagccccaccaccagccccacccagcccagccugagccagagcgccaccagcgccgccauccaggacaugcaccccagccccaccaacagaagcagaagaaaccuggagauggagaucauccugacccugagccagggccugaagaaguacuacggcaagauccugaagcugcuggaccugacccuggaggaggacaccgagggccugcuggaguggugcaagagaaaccuggaccugaccugcgacgagaacuucuuccugaagagaaucgaggaguucuuccugagcggcgagggccacuucaacgaggugcugcaguucaaggcccccagcaccaugagcagcaccgagcccacccacgccggcccccccaccguggagcccuucaagagcuacuucgccaagggcuuccugagcaucgacagcggcuacuucagcgccaagugcuaccccagaaccagcaacagcggccugcagcugaucaacgugacccagcacaccgccagaaucgccgacacccccggccccaagaucaccaacgugaagaccaucaacugcaucaaccugaaggccagcguguucaagaagcacagagagguggagaucaacgugcugcugccccagaucgccgugaaccugagcaacugccacgugcugaucaagagccacgugugcgacuacagccugaacuucgacggcauggugagacugcccagaauccaccacgagggcaccuucauccccggcaccuacaagaucgugaucgacagaaagaacaagcagaacgacagaugcacccuggugaccaacugcgugaucaagggcagagaggugagaaagggccagagcgcccugagacaguacagaaccgagaucaagaucggcgaggccagcaucggcagcagaagacugcugagcgaggagagcagcgacgacugcaucagcagaacccagcugcugagaaccgagaccgccgagauccacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggccaucuucuaccugcugaucaucgugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacguggugcacugccccaagagaaaggagaagaucgaggagaccgagcuguaccugaaccuggagagagugcccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcggcauccuguucaucgugagcugccugaugaagggccugguggacagcgugggcaacaacuucuuccccggccugaccaucugcaagaccugcagcaucagcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugccugagagugaccaccgaggugagcaacagagcccuguucaucagaagcaucaucaacaccaccuucgugaucugcauccugauccuggccgugugcgugaucagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugagcggcagaagcgagagcaucaugaagcuggaggagagaaccggcaucagcugggaccugggcguggaggacgccagcgagagcagacugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcagagaggacacccagaagugcgugagcaccaagcuggagcagccccagagcauccugaucgagcacaagggcaccaucaucggcaagcagaacaacaccugcaccaccaagaccaccugcuggcuggagagcgugaagagcuucuucuacggccugaagaacaugcugagcagcaucuucggcaacguguucgugggcaucuucagcuuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagagcaagcugcuggacggcgagagacuggccgacagaaagaucgccgagcuguucagcaccaagacccacaucggcuga

SEQ ID NO: 8737 - RNA, 5055 nt, Artificial Sequence
  derived and/or modified CDS sequence (opt4) from CCHFV(SPU415/85)__DQ211635.1__GP
auguacaccccccuggugugcgccgugaucugccugcagcuguggaaccugggcggcacccugguguucaucaacagaacccagcacaacgagaccggcaccguggccacccccgagggcacccugagacccagacugcccgugagcaccgcccugcccaccaagagcgacagacccagcgugggccccgccgccagcagcagcggccuggagggcagcggcgagcccaacaccagccccagcaucaccaccaagggccugaccccccccgagaccacccccgcccugcccaccgccaccgacaccgacgccagcagcaccggcgugguggacgugagcacccagaugaccaaggacauccccaugagcaccgccuacaccaacccccccagcacccccagcgcccccagcaccccccagggcacccaccacaccgccagaggccugcugagcguggccagcaccaagagcgaggaggugagcaugagcaccagccccgccaagaccagcaccgagaccagcagccccccccccgccaccagcgagacccccacccccagccccaccacccaggugcccaccggcaacaacaaccccaacaccagcagacagcccacccccagcgcccagcccgccaugagcaaccccgccaccagccccgcccagcccaaccugagccagagcgccccccccaccgccgaccagggcgugcaccccagccccaccaacagaagcaagagaaaccuggagaucgagaucauccugacccugagccagggccugagaaaguacuacggcaagauccugaagcugcuggaccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaaggugcccagcacccugagcagcaccgagcccacccacaccagaccccccaccguggagcccuucaagagcuacuucgccaagggcuuccugagcaugaacagcggcuacuucagcgccaagugcuaccccagaaccagcaacagcggccugcagcugaucaacgugaccaagcacagcgccaagaucgccgacacccccggccccaagaucaccaaccugaagaccaucaacugcaucaaccugagagccagcguguucaaggagcacagagagguggagaucaacgugcugcugccccagguggccgugaaccugagcaacugccacgcccagaucaagagccacgugugcgacuacagccuggccaccgacggcauggugagacugccccacauccaccacgagggcaccuucauccccggcaccuacaagaucgugaucgacaagaagaacaagcagaacgacagaugcacccuggugaccaacugcgugaucaagggcagagaggugagaaagggccagagcgcccugagacaguacaagaccgagaucagaaucggcaaggccagcagcggcagcagaagacugcugagcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucguggugagcugccuggugaagggccugaucgacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccaucgaggugagcaacagagcccugcugaucagaaacaucaucaacaccaccuucguggugugcauccugacccuggccgugugcguggugagcaccagcgccguggagauggagagccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggcuga

SEQ ID NO: 8738 - RNA, 5055 nt, Artificial Sequence
  derived and/or modified CDS sequence (opt4) from CCHFV(SPU 431/85)__KJ682812.1__GP
auguacaccccccuggugugcgccgugaucugccugcagcuguggaaccugggcggcacccuggugagcaccaacagaacccagcacaacgagaccggcaccguggccacccccgagggcacccugagacccagacugcccgugagcaccgcccugcccaccaagagcgacagacccagcgugggccccgccgccagcagcagcggccuggagggcagcggcgagcccaacaccagccccagcaucaccaccaagggccugaccccccccgagaccacccccgcccugcccaccgccaccgacaccgacgccagcagcaccggcgugguggacgugagcacccagaugaccaaggacauccccaugagcaccgccuacaccaacccccccagcacccccagcgcccccagcaccccccagggcacccaccacaccgccagaggccugcugagcguggccagcaccaagagcgaggaggugagcaugagcaccagccccgccaagaccagcaccgagaccagcagccccccccccgccaccagcgagacccccacccccagccccaccacccaggugcccaccggcaacaacaaccccaacaccagcagacagcccacccccagcgcccagcccgccaugagcaaccccgccaccagccccgcccagcccaaccugagccagagcgccccccccaccgccgaccagggcgugcaccccagccccaccaacagaagcaagagaaaccuggagaucgagaucauccugacccugagccagggccugagaaaguacuacggcaagauccugaagcugcuggaccugacccuggaggaggacaccgagggccugcuggaguggugcaagagaaaccugggccugaccugcgacgacaacuucuuccagaagagaaucgaggaguucuuccugaccggcgagggcuacuucaacgaggugcugcaguucaaggugcccagcacccugagcagcaccgagcccacccacaccagaccccccaccguggagcccuucaagagcuacuucgccaagggcuuccugagcaugaacagcggcuacuucagcgccaagugcuaccccagaaccagcaacagcggccugcagcugaucaacgugaccaagcacagcgccaagaucgccgacacccccggccccaagaucaccaaccugaagaccaucaacugcaucaaccugagagccagcguguucaaggagcacagagagguggagaucaacgugcugcugccccagguggccgugaaccugagcaacugccacgcccagaucaagagccacgugugcgacuacagccuggccaccgacggcauggugagacugccccacauccaccacgagggcaccuucauccccggcaccuacaagaucgugaucgacaagaagaacaagcagaacgacagaugcacccuggugaccaacugcgugaucaagggcagagaggugagaaagggccagagcgcccugagacaguacaagaccgagaucagaaucggcaaggccagcagcggcagcagaagacugcugagcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucguggugagcugccuggugaagggccugaucgacagcgugggcaacagcuucuuccccggccugagcaucugcaagaccugcagcaucggcagcaucaacggcuucgagaucgagagccacaagugcuacugcagccuguucugcugccccuacugcagacacugccccgccgacagagagauccacaagcugcaccugagcaucugcaagaagagaaagaccggcagcaacgugaugcuggccgugugcaagagaaugugcuucagagccaccaucgaggugagcaacagagcccugcugaucagaaacaucaucaacaccaccuucguggugugcauccugacccuggccgugugcguggugagcaccagcgccguggagauggagagccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcagaaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggcuga

SEQ ID NO: 8739 - RNA, 5055 nt, Artificial Sequence
  derived and/or modified CDS sequence (opt4) from CCHFV(8402)__AB069674.1__GP
auguacaccccccugcugugcgccgugcugugccugcagcuguggagccuggagggcagccacggccugagcaacaagacccagcacagcaacaccagcaccaccaaggcccccgaggugagccaggagcugggccugcccgugagcaccgugagcaccaucaccagcgacccccccagcaucaccagcgccgugagcgugagcggcagcgagggcagcggcgacaccaacaccagccccagcgugaccacccagggccccacccugcccgagaccacccuggagccccugaccaccaccgacaccgacgccagcagcaccguggugguggacgugagcacccagaccgugaaggacacccccaucagcaccaccuacaccagccugcccagcacccccagcgagcccaccaccccccagggcacccaccacaccgccagaggccugcugagcgugaccagcaccaagcccgaggaggccagcacccaggccaaccccggcaagaucagcauggagaccaacggccccagacuggccaucagcgagacccccagcuucagccccaccacccaggcccccaccgagaacagcaaccccaucaccagcaagcagcugaugcugagcgcccagcccgugacccccaaccccaugaccagccccgugcagcccgcccugagccagagcgacaccagcaccgccauccaggacgugcaccccagccccaccggcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacaacuucuuccagaagagaaucgaggaguucuuccugaccggcaagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaagaucaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8740 - RNA, 5055 nt, Artificial Sequence
  derived and/or modified CDS sequence (opt4) from CCHFV(SPU 383/87)__KJ682806.1__GP
auguacaccccccugcugugcgccauccugugccugcagcuguggagccuggagggcaucuacggccugagcaacagaacccagcacaacgacaccagcaccaucaaggugcccgaggagagccagaagaccagccugcccgccaacaccgccagccccaucaccagcgacccccccagcaccaccagcaccgccagcgccagcggccccgagggcagcggcgacaccagcaccagcccccccgugaccacccagggccccaccccccccgagaccacccccgagccccacaccaccaucgacaucgacaagagcagcaccgccaucgccgacaucagcacccagaccgugaaggacauccccacccccaccacccacaccagccugcccagcacccugagcgcccccaccaucccccaggaggcccaccacaccgccagaggccugcugagcaucaccagcaccaagcccggcgaggccagcacccccaucagccccggcgaggccagcaccgaggccagcagcccccagcccaccaucagcgagacccccagccccccccccaccgcccaggcccccaccgagaucaacagccccaacaccagcagacagcccaugcccagcacccagcccgccgcccccaacagcgugacccaccccgcccagcccacccccagccagagcgacgugcccaccgccgcccaggacauccaccccaaccccaucaacagaagcaagagaaaccuggagauggagaucauccugacccugagccagggccugaagaaguacuacggcaaggugcugaagcugcuggaccugacccuggaggaggacaccgagggccugcuggagagcugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugagcauggacagcggcuacuucagcgccaagugcuacagcaagagcagcaacagcggccugcagcugaucaacgugacccagcaccugaucagaaucaccgacacccccggccccaagaucaccaaccugaagaccaucaacugcaucaaccugaaggcccugguguucaaggagcacagagagaucgagaucaacgugcugcugccccagguggccgugaaccugagcaacugccacgugcugaucaagagccacgugugcgacuacagccuggacaucgacggccccgugagacugcccagaauccaccacgagggcaccuucauccccggcaccuacaagaucgugaucgacaagaacaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcuggugguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugauccagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucuucggcaagcagaacgacaccugcaccgccaaggccagcugcuggcuggagagcgugaagagcuucuucuacggccugaagaacaugcugagcggcaucuucggcaacguguucaucggcguguuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8741 - RNA, 5055 nt, Artificial Sequence
  derived and/or modified CDS sequence (opt4) from CCHFV(SPU 497/88)__KJ682808.1__GP
auguacaccccccugcugugcgccauccugugccugcagcuguggagccuggagggcaucuacggccugagcaacaagacccagcacaacgacaccagcaccaucaaggugcccgaggagagccagaagaccagccugcccgccaacaucgccagccccaccaccagcgacccccccagcgccaccagcaccgccagcgccagcggccccgagggcagcggcgacaccagcaccagccccagcgugaccacccagggccccaccccccuggagaucacccccgagccccacaccaccaucgacaucgacaagagcagcaccagcaucgccgacaucagcaccagaaccgugaaggacauccccacccccaccacccacaccagccugcccagcacccccagcgcccccaccaucccccaggaggugcaccacaccgccagaggccugcugagcgugaccagcaccaagcccgaggaggccagcacccugaccagccccggcgaggccagcaccgaggccagcagcccccagcccaccaucagcgagacccccagccccccccccaccacccaggcccccaccgagaucaacaaccccaacaccagcagacagcccaugcccagcacccagcccgccgcccccaacagcgugaccccccccgugcagcccaccuucagccagagcgacgugagcaccgccgcccaggacauccaccccagccccaccaacagaagcaagagaaaccuggagauggagaucauccugacccugagccagggccugaagaaguacuacggcaaggugcugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugagcauggacagcggcuacuucagcgccaagugcuaccccaagagcagcaacagcggccugcagcugaucaacgugacccagcaccugaucagaaucaccgacacccccggccccaagaucaccaaccugaagaccaucaacugcaucaaccugaaggcccugguguucaaggagcacagagagaucgagaucaacgugcugcugccccagguggccgugaaccugagcaacugccacgugcugaucaagagccacgugugcgacuacagccuggacaucgacggccccgugagacugcccagaauccaccacgagggcaccuucauccccggcaccuacaagaucgugaucgacaagaagaccaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcaagggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcggcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccuggagcaacgugaugcuggccgugugcaagagaaugugcuucagagccaccguggaggugagcaacaaggcccugcugaucagaaacaucaucaacaccaccuucguggugugcauccugauccuggccaucugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugagaaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccagagccagcugcuggcuggagagcaucaagagcuucuucuacggccugaagaacaugcugagcggcaucuucggcaacguguucaucggcaucuuccuguucuucgcccccuucaucaugcugauccuguucuucauguucggcuggagaauccuguucugcuucaagugcugcagaagaaccagaggccuguucaaguacagacaccugaaggacgacgaggaggugggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8742 - RNA, 5055 nt, Artificial Sequence
  derived and/or modified CDS sequence (opt4) from CCHFV(88166)__AB069675.1__GP
auguacaccccccugcugugcgccgugcugugccugcagcuguggagccuggagggcagccacggccugagcaacaagacccagcacagcaacaccagcaccaccaaggcccccgaggugagccaggagcugggccugcccgugagcaccgugagcaccaucaccagcgacccccccagcaucaccagcgccgugagcgugagcggcagcgagggcagcggcgacaccaacaccagccccagcgugaccacccagggccccacccugcccgagaccacccuggagccccugaccaccaccgacaccgacgccagcagcaccguggugguggacgugagcacccagaccgugaaggacacccccaucagcaccaccuacaccagccugcccagcacccccagcgagcccaccaccccccagggcacccaccacaccgccagaggccugcugagcgugaccagcaccaagcccgaggaggccagcacccaggccaaccccggcaagaucagcauggagaccaacagccccagacuggccaucagcgagacccccagcuucagccccaccacccaggcccccaccgagaacagcaaccccaucaccagcaagcagcugaugcugagcgcccagcccgugacccccaaccccaugaccagccccgugcagcccgcccugagccagagcgacaccagcaccgccauccaggacauccaccccagccccaccggcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacaacuucuuccagaagagaaucgaggaguucuuccugaccggcaagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaagaucaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccuggagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgaccugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8743 - RNA, 5055 nt, Artificial Sequence
  derived and/or modified CDS sequence (opt4) from CCHFV(strain BA88166)__AF338470.1__GP
auguacaccccccugcugugcgccgugcugugccugcagcuguggagccuggagggcagccacggccugagcaacaagacccagcacagcaacaccagcaccaccaaggcccccgaggugagccaggagcugggccugcccgugagcaccgugagcaccaucaccagcgacccccccagcaucaccagcgccgugagcgugagcggcagcgagggcagcggcgacaccaacaccagccccagcgugaccacccagggccccacccugcccgagaccacccuggagccccugaccaccaccgacaccgacgccagcagcaccguggugguggacgugagcacccagaccgugaaggacacccccaucagcaccaccuacaccagccugcccagcacccccagcgagcccaccaccccccagggcacccaccacaccgccagaggccugcugagcgugaccagcaccaagcccgaggaggccagcacccaggccaaccccggcaagaucagcauggagaccaacagccccagacuggccaucagcgagacccccagcuucagccccaccacccaggcccccaccgagaacagcaaccccaucaccagcaagcagcugaugcugagcgcccagcccgugacccccaaccccaugaccagccccgugcagcccgcccugagccagagcgacaccagcaccgccauccaggacauccaccccagccccaccggcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacaacuucuuccagaagagaaucgaggaguucuuccugaccggcaagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaagaucaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaagggcaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccuggagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguaccuggacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaucaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8744 - RNA, 5055 nt, Artificial Sequence
  derived and/or modified CDS sequence (opt4) from CCHFV(SPU 130/89)__KJ682807.1__GP
auguacaccccccugcugugcgccauccugugccugcagcuguggagccuggagggcaucuacggccugagcaacaagacccagcacaacgacaacagcaccaccaaggcccccgaggagagccacaagaccagccugcccgccaacaccgccagccccaucaccagcgacccccccagcaccaccagcaccaccagcgccagcggccccgagggcagcggcgacaccagcaccagcccccccgugaccacccagggccccgccagccccgagaccacccccgagccccacaccaccaucgacaucgacaagagcagcaccgccaucgccgacaucagcacccagaccgugaaggacauccccacccccaccacccacaccagccugcccagcacccugagcgcccccaccaucccccaggaggcccaccacaccgccagaggccugcugagcgugaccagacacaagcccggcgaggccagcaagcccaccagccccggcgaggccagcaccgaggccagcagcagccagcccaccaucagcgagacccccagccccccccccaccacccaggcccccaccgagaucaacaaccccaacaccagcagacagcccaugcccagcacccagcccgccgcccccagcagcgugacccaccccgcccagcccacccccagccagagcgacgugcccaccgccgcccaggacauccaccccagccccaccaacagaagcaagagaaaccuggagauggagaucauccugacccugagccagggccugaagaaguacuacggcaaggugcugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugagcauggacagcggcuacuucagcgccaagugcuaccccaagagcagcaacagcggccugcagcugaucaacgugacccagcaccugaucagaaucaccgacacccccggccccaagaucaccaaccugaagaccaucaacugcaucaaccugaaggcccugguguucaaggagcacagagagaucgagaucaacgugcugcugccccagguggccgugaaccugagcaacugccacgugcugaucaagagccacgugugcgacuacagccuggacaucgacggccccgugagacugcccagcauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagcccaacuacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccugagccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagagcacugcaagagcugcagcaaggaggacacccagagaugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcguguuccuguuccuggcccccuucaucauccugauccuguucuucauguucggcuggagaauccuguucugcuucaagugcugcagaagaaccagaggccugcugaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8745 - RNA, 5052 nt, Artificial Sequence
  derived and/or modified CDS sequence (opt4) from CCHFV(4701-ST-2009)__KR814872.1__GP
augcacacccugcuggugugcuucauccuguaccugcagcugagcggccugggcggcgcccacggccagagcaacgccaccgagcacaacggcaccaacaccaccaccgcccccggcaccagccagagccccaagccccccgccagcaccacccugccccacacccccgagagcagcaccgugaagcugaccacccccaccagcgagaccgagggcagcggcgagaccacccccccccccaacaccacccagggccugccccugaccggcaccacccccgagagaagcgccaccaccgccaccagcaccagcagcaccgacaacaugaacagcaccacccaggugaccgacaacacccccaccagcaccgugagcaucagccccagcagcagcagcagcaugcccagcaccccccagggcacccaccaccccgugagaagccugcugagcgugagcagccccaagaccgugaccacccccacccccaugagccccggcgagaugagccccgagaccagcagccagcacagcgccaugagcagagugcccacccuguacaccgccacccaggugagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcggcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8746 - RNA, 5052 nt, Artificial Sequence
  derived and/or modified CDS sequence (opt4) from CCHFV(36-ST-2014)__KR814857.1__GP
augcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaugagcagcaccgacaacaugaacagcaccacccaggugaccgacaacacccccaccagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaccaacagaagcacccccagacagagcgagagcagcgcccagcccgccacccagagccccaccaccagccccacccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugagcgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaaguuccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggcuga

SEQ ID NO: 8747 - RNA, 5055 nt, Artificial Sequence
  derived and/or modified CDS sequence (opt4) from CCHFV(Matin)__AF467769.2__GP
auguacacccugcugcugugcgccauccugugcagccagcuguggagcagcgagggcauccacggccugagcaacgagacccagcacggcaacgccagcaccaucaaggcccccgaggugagccagggccugggccugcccgugagcaccgccccccccaucaccagcgacccccccagcaucaccagcgccgccagcgugagcggccccgagggcagcggcgacaccaacaccagcccccccgugaccacccagggccugacccugcccgagaccacccuggagcugcugaccaccaccaacaccggcgccagcagcaccgugaucguggacgugagcacccagaccgugaaggacacccccgugagcaccgcccacaccagcccccccggcacccccagcgcccccaccaccccccagggcacccaccacaccgccagaggccugcugagcgugaccagcaccaagagcgaggaggccagcacccagaccaaccccaagaagaccagcauggagaccaacagccccggccccgccaccagcgagacccccagccccagccccaccacccaggcccccaccgagaacaacaaccccaacacccccagacagcccaccccccccacccagcccgccacccccagccccgugaccagccccgcccugcuggccagcagccagggcgacaccagcaccgccgugcaggacgugcaccccagccccaccaacagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacagcuucuuccagaagagaaucgaggaguucuuccugaccggcgagggccacuucaacgaggugcugcaguucaagacccccagcacccugagccccaccgagcccgccagagccggcagccccaccguggagcccuucaagagcuacuucgccagaggccugcugagcauggacagcggcuacuucagcgccaagugcuaccccagagccagcaacagcggccugcagcugaucaacaucacccagcacagcgccagaaucaccgacacccccggccccaagaucaccaaccugaagaccaucaacugcaucaaccugaaggccagcaccuucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcaccaucgugaccaacugcgugaucaagggcagagagaucagaaagggccagagcgugcugagacaguacaagaccgagaucaagaucggcaaggccagcagcggcagcagaagacugcugagcgaggagagcggcgacgacugcaucagcagaacccagcugcugagaaccgagaccgccgagauccacagcgacagcuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaucagagagggcuacaccagcgugugccuguucgugcugggcagcauccuguucaucgugagcugccugaugaagggccugguggacagcgacggcaacagcuucuuccccggccugagcaucugcaagaccugcagcaucggcagcaucaacggcuucgagaucgagagccacaagugcuacugcagccuguucugcugccccuacugcagacacugcagcaccgacagagagauccacaagcugcaccugagcaucugcaagaagagaaagaccggcagcaacgugaugcuggccgugugcaagagaaugugcuucagagccaccguggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaucaacuucugccaccaggagugccaggugaccgagaccgagugccugugccccuacgaggcccuggugcugagaaagccccuguuccuggacagcaucaucaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggugaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugagcaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucgcccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacgugggcuga

SEQ ID NO: 8748 - RNA, 5052 nt, Artificial Sequence
  derived and/or modified CDS sequence (opt4) from CCHFV(UCCR4405)__KY484029.1__GP
augcacgcccugcuggugugcuucauccuguaccugcagcugagcggccugggcggcgcccacagacagagcaacgccaccgagcacaacggcaccaacaccaccaccgcccccggcaccagccagagccccaagccccccgugagcaccacccugccccacacccccgaggccagcaccaucaagcugaccacccccaccagcgagaccgagggcagcggcgagaccacccccccccccaacaccacccagggccugccccugcccggcaccacccccgagagaagcgccaccaccgccaccagcaccagcagcaccgacgacaugaacagcaccacccagaugaccgacaacacccccaccagcaccgugagcaucggccugagcagcagccccagcaugcccagcaccagccagggcauccacuaccccgugagaagccugcugagcgugagcagccccaagaccgccaccacccccacccccaugagccccggcgaggugagccccgagaccagcagccagcacagcgccaugagcagaauccccacccuguacaccgccacccaggugagcaccgagaacaccaacagaagcauccccagacagagcgagagcagcgugcagcccgccacccagagccccaucaccagccccgcccagaccauccugcugaugagcgccgcccccaccgccauccaggacaugcaccccagccccaagaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccccagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcgccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacuacagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugauccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8749 - RNA, 5052 nt, Artificial Sequence
  derived and/or modified CDS sequence (opt4) from CCHFV(Drosdov)__DQ211630.1__GP
augcacgcccugcuggugugcuucauccuguaccugcagcugagcggccugggcggcgcccacagacagagcaacgccaccgagcacaacggcaccaacaccaccaccgcccccggcaccagccagagccccaagccccccgugagcaccacccugccccacacccccgaggccagcaccaucaagcugaccacccccaccagcgagaccgagggcagcggcgagaccacccccccccccaacaccacccagggccugccccugcccggcaccacccccgagagaagcgccaccaccgccaccagcaccagcagcaccgacgacaugaacagcaccacccagaugaccgacaacacccccaccagcaccgugagcaucggccugagcagcagccccagcaugcccagcaccagccagggcauccacuaccccgugagaagccugcugagcgugagcagccccaagaccgccaccacccccacccccaugagccccggcgaggugagccccgagaccagcagccagcacagcgccaugagcagaauccccacccuguacaccgccacccaggugagcaccgagaacaccaacagaagcauccccagacagagcgagagcagcgugcagcccgccacccagagccccaucaccagccccgcccagaccauccugcugaugagcgccgcccccaccgccauccaggacaugcaccccagccccaagaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccccagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcgccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacuacagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugauccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaugaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8750 - RNA, 5052 nt, Artificial Sequence
  derived and/or modified CDS sequence (opt4) from CCHFV(44-ST-2010)__KR814859.1__GP
augcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaugagcagcaccgacaacaugaacagcaccacccaggugaccgacaacacccccaccagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaccaacagaagcacccccagacagagcgagagcagcgcccagcccgccacccagagccccaccaccagccccacccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccugcugugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcuucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugagcgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggcuga

SEQ ID NO: 8751 - RNA, 5052 nt, Artificial Sequence
  derived and/or modified CDS sequence (opt4) from CCHFV(3756-ST-2007)__KR814866.1__GP
augcacacccugcuggugugcuucauccuguaccugcagcugagcggccugggcggcgcccacggccagagcaacgccaccgagcacaacagaaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugccccugcccggcaccacccccgagagaagcgccaccaccgccaccagcaccagcagcaccgacaacaugaacaccaccacccaggugaccgacaacacccccaccagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaucaacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccugacccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8752 - RNA, 5052 nt, Artificial Sequence
  derived and/or modified CDS sequence (opt4) from CCHFV(47-ST-2013)__KR814861.1__GP
augcacacccugcuggccugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagaagcgccaccaccgccaccagcaccagcagcaccgacaacaugaacagcaccacccagaugaccggcaacacccccacccccaccgugaacaugagccccagcagcagccccagcaugcccagcaccagccagggcauccacuaccccgugagaagccugcugagcgugcccagccccaagaccgccaccacccccacccccgugagccccggcgagaugagccccgagaccagcagccagcacagcgccaccagcagaauccccacccuguacaccgccacccaggugagcaccgagaacaccaacagaagcacccccagacagagcaagagcagcgugcagcccgccacccagagccccaucaccccccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuacgccaagggcuuccugagccuggacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacccccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccuguucaucagaagcaucaucaacaccaccuucgugaccugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgagugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8753 - RNA, 5052 nt, Artificial Sequence
  derived and/or modified CDS sequence (opt4) from CCHFV(1-CR/HU-2015)__KU161584.1__GP
augcacacccugcuggugugcuucauccuguaccugcagcugcugggccugggcggcgcccacgagcagagcaacgccaccgaccacaacagaaccaacaccaucaccgcccccagcaccagccagaaccccaagccccccgccagcaccacccccccccacacccccgagagcagcaccaucaagcugaucaccagcaccggcgaggccgagggcagcggcgagaccacccccccccugaacaccacccagggccccuucccccccgagaccaccagcgagcaccccgccagcaccgccaccaacaccagcagcaccaacagcaugaacagcaccacccagaugaccgacaacacccugaccagcaccgugagcaccagccugagcaucagccccagcacccccagcaccagccagggcauccacuaccccgugagaagccugcugagcgugagcagccccaagaccgccgccacccccacccccaugagcaccagagagaugagcagcgagaccagcagccagcacagcgccaugagcagaacccccaccuuccacaccgccacccaggugagcaccgagaacgccaacagaagcacccccagacagagcgagagcagcgcccagcccgccacccagagccccaugaccagccccgcccagagcaucuuccuggugagcgccgcccccaccaccauccagaacauccaccccagccccaccaacagaagcaagagaaaccuggagauggagaucauccugacccugccccagggccugaagaaguacuacggcaagauccugaagcugcugcaccugacccuggaggaggacaccgagggccugcuggaguggugcaagagaaaccugggcagcaacugcgacgacgaguucuuccagaagagaaucgaggaguucuucaucaccggcgagggcuacuucaacgaggugcugcaguucaagacccugagcacccugagccccaccgagcccagccacgccagaccccccaccgccgagcccuucaagagcuacuucgccaagggcuuccugagcaucgacagcggcuacuucagcgccaagugcuaccccagaagcagcaccagcggccugcagcugaucaacaucacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccauggaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8754 - RNA, 5049 nt, Artificial Sequence
  derived and/or modified CDS sequence (opt4) from CCHFV(3820-ST-2007)__KR814868.1__GP
augcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccaccccccccaacaccacccagggccugccccugcccggcaccacccccgagagaagcgccaccaccgccaccagcaccagcagcaccgacaacaugaacagcaccacccaggugaccgacaacacccccaccagcaccgugagcaucagccccagcagcagcagcagcaugcccagcaccagccagggcauccaccaccccgugagaagccugcugagcgugagcagccccaagaccgugaccacccccacccccaugagccccggcgagaugagccccgagaccagcagccagcacagcgccaugagcagagugcccacccuguacaccgccacccagaucagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaagaccagcaccggcagcagaaagcugcugagcgaggagcccggcgacgacugcaucagcagaacccagcugcugaagaccgagaccgccgagauccacgacgacaacuacggcagccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcuggccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8755 - RNA, 5052 nt, Artificial Sequence
  derived and/or modified CDS sequence (opt4) from CCHFV(Ast199)__KX056051.1__GP
augcacacccugcuggugugcuucauccuguaccugcagcugagcggccugggcggcgcccacgugcagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccaccaccagcagcaccgacaacaugaacagcaccacccaggugaccgacaacacccccaccagcaccgugagcaucagccccagcagcaaccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccgcccaggugagcaccgagaacaccaacagaagcacccccagacagagcgagagcagcgcccagcccgccacccagagccccaccaccuuccccgcccagaccaucccccugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccccagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaugcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggcuga

SEQ ID NO: 8756 - RNA, 5052 nt, Artificial Sequence
  derived and/or modified CDS sequence (opt4) from CCHFV(Turkey200310849)__DQ211636.1__GP
augcacacccugcuggugugcuucauccuguaccugcagcugcugugccugggcggcgcccacggccagcugaacaccaccgagcacaacggcaccaacaacaccaccgcccccggcgccagccagagccccaagccccccaugagcaccacccccccccacgcccccgagagcagcaccaucaagcccaccacccccaucagcgaggccgagggcagcggcgagaccaccagcacccccaacaccacccagggccugagcagccccgagaccaccagcgagagacccgccaccaccgccaucagcaccagcagcaccgacagcaccaaccccaccacccagaugaccgacaacacccccacccugaccgugagcaccagccccagcagcagccccagcacccccagcaccccccagggcaucuaccaccccgccagaagccugcugagcgugagcagccccaagaccgugaccacccccacccccaccagccccggcgagaugagcagcgagaccagcagccagcacagcgccaugagcagaauccccaccccccacaccgccaccagagugagcaccgagaacaccaaccacagcacccccagacagagcgagagcagcgcccagcagaccacccccagccccaugaccagccccgcccagagcauccugcugaugagcgccgcccccaccgccgugcaggacauccaccccagccccaccaacagaagcaagagaaaccuggagaccgagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagacugcccaccgccgagcccuucaagagcuacuucgccaagggcuuccugagcaucgacagcggcuacuucagcgccaagugcuaccccagaagcagcgccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcuucagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucagcugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgacagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccgccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggcuga

SEQ ID NO: 8757 - RNA, 5052 nt, Artificial Sequence
  derived and/or modified CDS sequence (opt4) from CCHFV(5170-R-2011)__KR814873.1__GP
augcacacccugcuggugugcuucauccuguaccugcagcugagcggccugggcggcgcccacggccagagcaacgagaccgagcacaacggcaccaacaccaccaccgugcccggcaccagccagagccccaagccccccgccagcaccacccugcagcacacccccgagagcagcaccgugaagcugaccacccccaccagcgagaccgagggcagcggcgagaccacccccccccccaacaccacccagggccugcccccccccggcaccacccccgagagaagcgccaccaccgccaccagcaccagcagcaccgacaacaugaacagcaccacccaggugaccgacaacacccccaccagcaccgugagcaucagccccagcagcagccccagcaugcccagcaccagccagggcauccacuaccccaucagaagccugcugagcgugagcagccccaagaccgugaccacccccacccccaucagccccggcgagaugagccccgagaccagcagccagcacagcgccaugagcagaauccccacccuguacaccgccacccaggugagcaccgagaacaccaacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcugagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8758 - RNA, 5055 nt, Artificial Sequence
  derived and/or modified CDS sequence (opt4) from CCHFV(SCT ex Afghanistan)__KC344856.1__GP
auguacacccugcuggugugcgccauccugugcccccagcccuggagccuggagggcacccacgugccccugaacggcaccaagcacaacggcaccggcaucaccgccgcccccggcggcagccagggccccaccagccccgccagcaccgccgugagccugacccccgaccccuucaccaccgagcccaccgccagcgccguggagcuggagagcagcggcgagggccacaccagccugagcgugaccacccagggccugaccagccccgagaccacccccggccugcccaccgugaccgacaccggcgugagcagcaccagcaucuucggcaucggcaucagaguggccggcgacacccccaccagcaccacccacaccggccugcccagcagccccagcaugcccagcaccgcccagggcccccaccacgccgugagaggccugcugagcgugagcagcaccagacccggcgaggccagcaccaucaccgugcccggcgaggccggcaccgaggccaacagcagcagcagcgccaucagcaagaagcccgcccccagccccaccgccgaggccaucaccgaggccaacaacagcagcaaccccagacagcccgagcugagcacccagcccgccauccccggccuggugaccagcagcgcccagcccauccugcugcagagcgccaccagcaccgccgcccaggacaucuaccccagccccaccaacagaagcaagagaaaccuggagauggagaucauccugacccugagccagggccugaagaaguacuacggcaagauccugagaauccuggaccugacccuggaggaggacaccgagggccugcuggaguggugcaagagaaaccugggccugaccugcaacgacaacuucuuccaggagagaaucgaggaguucuuccugaccggcgagggccacuucaacgaggugcugcaguucaagacccccagcacccugagccccaccgagcccacccacaccagaacccccaccgugaagcccuucaagagcuacuucgccagaggcuuccugagcaucgacagcggcuacuucagcgccaagugcuacagcaagaccagcaacagcggccugcagcugaucaacaucacccagcaccccgccagaaucgccgacacccccggccccaagaucaccaaccugaaggccaucaacugcaucaaccugaaggccagcguguucaaggagcacagagagaucgagaucaacgugcugcugccccagguggccgugaaccugagcaacugccacgugcugaucaagagccacgugugcgacuacagccuggacaucgacggcgccgugagacugccccacgugcaccacaagggcaccuucauccccggcaccuacaagaucgugaucgacaagagaaacaagcagaacgacagaugcacccuggugaccaacugcgugaucaagggcaaggagaucagaaagggccagagcgcccugagacaguacagaaccgagaucagaaucggcaaggccagcgccggcagcagaagacugcugagcgaggagagcggcgacgacugcaucagcagaacccagcugcugagaaccgagaccgccgaggugcacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcaagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggugaucuucuaccugcugaucguggugggcacccugggcaagaaguucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaucagcgugugccuguucgugcugggcggcauccuguucguggugagcugccugaucaagggccugguggacagcgugggcaacagcuucuuccccggccugagcaucugcaagaccugcagcaucggcagcgugaacggcuucgagaucgagagccacaagugcuacugcagccugcugugcugccccuacugcagacacugcagcaccgacagagagauccaccagcugcaccugagcaucugcaagaagagaagaaccggcggcaacgugaugcuggccgugugcaagagaaugugcuucagagccaccauggaggugagcaacaaggugcuguucaucagaaacaucaucaacaccaccuucgugaucugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccugaacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagagccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaagcugaacggccacaugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgacaucagcggccugaaguucgccagccugaccugcgccggcugcuacgccugcagcagcggcaucagcugcaaggugagaauccacguggacgagcccgacgagcugaccgugcacgugaagagcgaggaccccgacaucguggccgccagcaccagccugaucgccagaaagcuggagcugggcaccgacagcaccuucaaggccuucagcgccaugcccaagaccagccugugcuucuacaucguggagagagaguacugcaagagcugcagcaaggaggacacccagaagugcgugaacaccaagcuggagcacccccagggcauccugaucgagcacaagggcaccaucaucggcaagcagaacgacaccugcaccgccaaggccggcugcuggcuggagagcgugaagagcuucuucuacggccugaagaacaugcugagcggcaucuucggcaacguguucaucggcaucuuccuguuccuggcccccuucgugcugcugauccuguucuucauguucggcuggagacugcuguucugcuucaagugcugcagaagaaccagaggccuguucaaguacagacaccugaaggaggacgaggagagcggcuacagaagaaucaucgagagacugaacaacaagaagggcaagaacaagcugcuggacggcgagagacuggccgacagaagaaucgccgagcuguucagcaccaagacccacaucggcuga

SEQ ID NO: 8759 - RNA, 5055 nt, Artificial Sequence
  derived and/or modified CDS sequence (opt4) from CCHFV(SPU 44/08)__KJ682805.1__GP
auguacaccccccugcugugcgccauccugugccugcagcuguggagccuggagggcaucuacggccugagcaacaacacccagcacaacgacaccagcaccaucaaggugcccgaggagagccagaagaccagccugcccgccaacaccgccagccccaucaccagcgaccccccccccaccacccccaccgccagcgccagcggccccgagggcagcggcgacaccagcaccagcccccccgugaccacccagggccccaccccccccgagaccacccccgagccccacaccaccaucgacaucgacaagagcagcaccgccaucgccgacaucagcacccagaccgugaagaacauccccacccccaccgcccacaccagccugcccagcacccugagcgcccccaccaugccccaggaggcccaccacaccgccagaggccugcugagcgugaccagcaccaagcccggcgaggccagcacccccaccagccccggcgaggccagcaccgaggccagcagcccccagcccaccaucagagagacccccagccccccccccaccacccagacccccaccgagaucaacaaccccaacaccagcagacagcccaugcccagcacccagcccgccgcccccagcagcgugacccaccccgcccagcccacccccagccagagcgacgugcccaccgccgcccaggacauccaccccagccccaccaacagaagcaagagaaaccuggagauggagaucauccugacccugagccagggccugaagaaguacuacggcaaggugcugaagcugcuggaccugacccuggaggaggacaccgagggccugcuggaguggugcaagagaaaccugggccugaccugcgacgacaacuucuuccagaagagaaucgaggaguucuuccugaccggcgagggccacuucaacgaggugcugcaguucaagacccccagcacccugagccccaccgagcccgccagaguggagagccccaccguggagcccuucaagagcuacuucgccaagggcuuccugcugauggacagcggcuacuucagcgccaagugcuaccccaagagcagcaacagcggccugcagcugaucaacgugacccagcaccugaucagaaucaccgacacccccggccccaagaucaccaaccugaagaccaucaacugcaucaaccugaaggcccugguguucaaggagcacagagagaucgagaucaacgugcugcugccccagguggccgugaaccugagcaacugccacgugcugaucaagagccacgugugcgacuacagcaucgacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugagaggccugguggacagcgugagcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8760 - RNA, 5052 nt, Artificial Sequence
  derived and/or modified CDS sequence (opt4) from CCHFV(K323_27)__KX013472.1__GP
augcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugccccugcccggcaccacccccgagagaagcgccaccaccgccaccagcaccagcagcaccgacaacaugaacagcaccacccaggugaccgacaacacccccaccagcaccgugagcaucagccccagcagcagccccagcaugcccagcaccagccagggcauccaccaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagagcagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucagcagccacgugugcgacuacagccuggacaccgacggccccgugagacugcccagaauccaccacgagggcaccuucauccccggcaccuacaagaucgugaucgacagaaaggacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaccgugcugcuggugcugcugaccgugagccugagccccgugcagagcgcccccgugggccacggcaacaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugcccccacugcagacacagaagcgccgacagagagauccaccagcugcaccugagcaucugcaagaagagaaagaccggcagcaacgugaugcuggccgugugcaagagaaugugccccaaggccaccaucgaggccagcagaagagcccugcccaucagaagcaucaucaacaccacccuggugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccggccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaacgacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8761 - RNA, 5052 nt, Artificial Sequence
  derived and/or modified CDS sequence (opt4) from CCHFV(1231-CR/TI-2015)__KU161585.1__GP
augcacacccugcuggugugcuucauccuguaccugcagcugcugggccugggcggcgcccacgagcagagcaacgccaccgaccacaacagaaccaacaccaucaccgcccccagcaccagccagaaccccaagccccccgccagcaccacccccccccacacccccgagagcagcaccaucaagcugaucaccagcaccggcgaggccgagggcagcggcgagaccacccccccccugaacaccacccagggccccuucccccccgagaccaccagcgagcaccccgccagcaccgccaccaacaccagcagcaccaacagcaugaacagcaccacccagaugaccgacaagacccugaccagcaccgugagcaccagccugagcaucagccccagcacccccagcaccagccagggcauccacuaccccaucagaagccugcugagcgugagcagccccagaaccgccgccacccccacccccaugagcaccagagagaugagcagcgagaccaacagccagcacagcgccgugagcagaacccccaccuuccacaccgccacccaggugagcaccgagaacgacaacagaagcacccccagacagagcgagagcagcgcccagcccgccacccagagccccaugaccagccccgcccagagcauccugcuggugagcgccgcccccaccaccauccagaacauccaccccagccccaccaacagaagcaagagaaaccuggagauggagaucauccugacccugccccagggccugaagaaguacuacggcaagauccugaagcugcugcaccugacccuggaggaggacaccgagggccugcuggaguggugcaagagaaaccugggcagcaacugcgacgacgaguucuuccagaagagaaucgaggaguucuucaucaccggcgagggcuacuucaacgaggugcugcaguucaagacccugagcacccugagccccauggagcccagccacgccagaccccccaccgccgagcccuucaagagcuacuucgccaagggcuuccugagcaucgacagcggcuacuucagcgccaagugcuaccccagaagcagcagcagcggccugcagcugaucaacaucacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaccaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggagagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccauggaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8762 - RNA, 5052 nt, Artificial Sequence
  derived and/or modified CDS sequence (opt4) from CCHFV(K229_194)__KX013463.1__GP
augcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaccagcagcaccgacaacaugaacagcaccacccaggugaccgacaacacccccaucagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccacccaggugagcaccgagaacaccaacagaagcacccccagacagagcgagagcagcgcccagcccgccacccagagccccaccaccagccccacccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugaacacccugagccccaccgagcccagccacgugagacugcccaccgccgagcccuucaagagcuacuucgccaagggcuuccugagcguggacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaagggcaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccagcuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacagcugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggcuga

SEQ ID NO: 8763 - RNA, 5052 nt, Artificial Sequence
  derived and/or modified CDS sequence (opt4) from CCHFV(K315_14)__KX013469.1__GP
augcacacccugcuggugugcuucauccuguaccugcagcugagcggccugggcggcgcccacggccagagcaacgagaccgagcacaacggcaccaacaccaccaccgugcccggcaccagccagagccccaagccccccgccagcaccacccugcagcacacccccgagagcagcaccgugaagcugaccacccccaccagcgagaccgagggcagcggcgagaccacccccccccccaacaccacccagggccugcccccccccggcaccacccccgagagaagcgccaccaccgccaccagcaccagcagcaccgacaacaugaacagcaccacccaggugaccgacaacacccccaccagcaccgugagcaucagccccagcagcagccccagcaugcccagcaccagccagggcauccacuaccccaucagaagccugcugagcgugagcagccccaagaccgugaccacccccacccccaucagccccggcgagaugagccccgagaccagcagccagcacagcgccaugagcagaauccccacccuguacaccgccacccaggugagcaccgagaacaccaacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucagaaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguguacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaagcugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8764 - RNA, 5055 nt, Artificial Sequence
  derived and/or modified CDS sequence (opt4) from CCHFV(BA8402)__AF350449.1__GP
auguacaccccccugcugugcgccgugcugugccugcagcuguggagccuggagggcagccacggccugagcaacaagacccagcacagcaacaccagcaccaccaaggcccccgaggugagccaggagcugggccugcccgugagcaccgugagcaccaucaccagcgagccccccagcaucaccagcgccgugagcgugagcggcagcgagggcagcggcgacaccaacaccagccccagcgugaccacccagggccccacccugcccgagaccacccuggagccccugaccaccaccgacaccgacgccagcagcaccguggugguggacgugagcacccagaccgugaaggacacccccaucagcaccaccuacaccagccugcccagcacccccagcgagcccaccaccccccagggcacccaccacaccgccagaggccugcugagcgugaccagcaccaagcccgaggaggccagcccccaggccaaccccggcaagaucagcauggagaccaacggccccagacuggccaucagcgagacccccagcuucagccccaccacccaggcccccaccgagaacagcaaccccaucaccagcaagcagcugaugcugagcgcccagcccgugacccccaaccccaugaccagccccgugcagcccgcccugagccagagcgacaccagcaccgccauccaggacgugcaccccagccccaccggcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacaacuucuuccagaagagaaucgaggaguucuuccugaccggcaagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaagaucaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagaucgugaucgacaagaagaacaagcagaacgacagaugcacccuggugaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaacagcuucaaccugugcgagaacaccgccaccggcaagagcugcgagaucgacagcacccccgugaagugcagacagggcuucugccugaagaucacccaggagggcagaggccacgugaagcugagcagaggcagcgagguggugcuggacgccugcgagagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacccaccagcgacggccuggccagacacgugaugcagugccccaagagaaaggagaagaucgaggagaccgcccuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccugcacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8765 - RNA, 5055 nt, Artificial Sequence
  derived and/or modified CDS sequence (opt4) from CCHFV(UCCR4459)__KY484032.1__GP
auguacaccccccugcugugcgccgugcugugccugcagcuguggagccuggagggcagccacggccugagcaacaagacccagcacagcaacaccagcaccaccaaggcccccgaggugagccaggaguucggccugcccgugagcaccgugagcaccaucaccagcgacccccccagcaucaccagcgccgugagcgugagcggcagcgagggcagcggcgacaccaacaccagccccagcgugaccacccagggccugacccugcccgagaccacccuggagcugcugaccaccaccgacaccgacgccagcagcaccguggugguggacgugagcacccagaccgugaaggacacccccaucagcaccacccacaccagccugcccagcacccccagcgccaccaccaccccccagggcacccaccacaccgccagaggccugcugagcgugaccagcaccaagcccgagggcgccagcacccaggccaaccccgagaagaucagcauggagaccaacagccccagacuggccaucagcgagacccccagcuucagccccaccacccaggcccccaccgagaacagcaaccccaucaccagcaagcagcugaucuucagcgcccagcccgugacccccaaccccgugaccccccccgugcagcccgcccugagccagagcgacaccagcaccgccauccaggacauccaccccagccccaccagcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacgacuucuuccagaagagaaucgaggaguucuuccugaccggcgagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaaggugaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagcuggugaucgacaagaagaacaagcagaacgacagaugcacccugaucaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8766 - RNA, 5052 nt, Artificial Sequence
  derived and/or modified CDS sequence (opt4) from CCHFV(Ast149)__KX056054.1__GP
augcacacccugcuggugugcuucauccuguaccugcagcugagcggccugggcggcgcccacggccagagcaacgccaccgagcacaacggcaccaacaccaccaccgcccccggcaccagccagagccccaagccccccgccagcaccacccccccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaccagcagcaccgacaacaugaacagcaccacccaggugaccgacaacacccccaccagcaccgugagcaccagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccgcccaggugagcaccgagaacgccaacagaagcacccccagacagagcgagagcagcgcccagcccgccacccagagccccaccaccuuccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucuacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcccaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggcccuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggcuga

SEQ ID NO: 8767 - RNA, 5052 nt, Artificial Sequence
  derived and/or modified CDS sequence (opt4) from CCHFV(Ast137)__KX056057.1__GP
augcacacccugcuggugugcuucauccuguaccugcagcugagcggccugggcggcgcccacggccagagcaacgccaccgagcacaacggcaccaacaccaccaccgugcccggcaccagccagagccccaagccccccgccagcaccacccugccccacacccccgagagcagcaccgugaagcugaccacccccaccagcgagaccgagggcagcggcgagaccacccccccccccaacaccacccagggccugcccccccccggcaccacccccgagagacccgccaccaccgccaccagcaccagcagcaccgacaacaugaacagcaccacccaggugaccgacaacacccccaccagcaccgugagcaucagccccagcagcagccccagcaugcccagcaccagccagggcauccacuaccccgugagaagccugcugagcgugagcagccccaagaccgugaccacccccacccccaugagccccggcgagaugagccccgagaccagcagccagcacagcgccaugagcagaauccccacccuguacaccgccgcccaggugagcaccgagaacaccaacagaagcacccccagacagagcgagagcagcgcccagcccgccacccagagccccaccaccuuccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacaagaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccauccacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcuaccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggcuga

SEQ ID NO: 8768 - RNA, 5055 nt, Artificial Sequence
  derived and/or modified CDS sequence (opt4) from CCHFV(C-68031)__DQ211629.1__GP
auguacaccccccugcugugcgccgugcugugccugcagcuguggagccuggagggcagccacggccugagcaacaagacccagcacagcaacaccagcaccaccaaggcccccgaggugagccaggaguucggccugcccgugagcaccgugagcaccaucaccagcgacccccccagcaucaccagcgccgugagcgugagcggcagcgagggcagcggcgacaccaacaccagccccagcgugaccacccagggccugacccugcccgagaccacccuggagcugcugaccaccaccgacaccgacgccagcagcaccguggugguggacgugagcacccagaccgugaaggacacccccaucagcaccacccacaccagccugcccagcacccccagcgcccccaccaccccccagggcacccaccacaccgccagaggccugcugagcgugaccagcaccaagcccgagggcgccagcacccaggccaaccccgagaagaucagcauggagaccaacagccccagacuggccaucagcgagacccccagcuucagccccaccacccaggcccccaccgagaacagcaaccccaucaccagcaagcagcugauccugagcgcccagcccgugacccccaaccccgugaccccccccgugcagcccgcccugagccagagcgacaccagcaccgccauccaggacauccaccccagccccaccagcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgacgacuucuuccagaagagaaucgaggaguucuuccugaccggcgagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaaggugaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagcuggugaucgacaagaagaacaagcagaacgacagaugcacccugaucaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcaucaacggcuucgagaccgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8769 - RNA, 5052 nt, Artificial Sequence
  derived and/or modified CDS sequence (opt4) from CCHFV(K340_6)__KX013475.1__GP
augcacacccugcuggugugcuucauccuguaccugcagcugagcggccugggcggcgcccacgugcagagcaacgccaccgagcacaacggcaccaacaccaccaccgcccccggcaccagccagagccccaagccccccgccagcaccacccugccccacacccccgagagcagcaccgugaagcccaccacccccaccagcgagaccgagggcagcggcgagaccacccccccccccaacaccacccagggccugccccccaccggcaccacccccgagagaagcgccaccaccgccaccagcaccagcagcaccgacaacaugaacagcaccacccaggugaccgacagcacccccaccagcaccgugagcaccagccccagcagcagcagcagcaugcccagcaccagccagggcauccaccaccccgugagaagccugcugagcgugagcagccccaagaccgugaccacccccacccccaugagccccggcgagaugagccccgagaccagcagccagcacagcgccaugagcagagugcccacccuguacaccgccacccaggugagcaccgagaacaccgacagaagcacccccagacagagcgagagcagcgugcagcccgccacccagagccccaucaccagccccgcccagaccauccugcugaugagcgccgcccccaaggccauccaggacaugcaccccagccccaccaacagaagcaagagaaaccuggagguggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccugagccccaccgagcccagccacgugagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaauccaccacgagggcaccuucauccccggcaccuacaagaucgugaucgacagaaagaacaagcugaacgacagaugcagccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcaccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacauccccccccugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccugagccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggaggugaccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacacuucaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8770 - RNA, 5055 nt, Artificial Sequence
  derived and/or modified CDS sequence (opt4) from CCHFV(Hy13)__AY900145.1__GP
auguacaccccccugcugugcgccgugcugugccugcagcuguggagccuggagggcagccacggccugagcaacaagacccagcacagcaacaccagcaccaccaaggcccccgaggugagccaggaguucggccugcccgugagcaccgugagcaccaucaccagcgacccccccagcaucaccagcgccgugagcgugagcggcagcgagggcagcggcgacaccaacaccagccccagcgugaccacccagggccugacccugcccgagaccacccuggagcugcugaccaccaccgacaccgacgccagcagcaccguggugguggacgugagcacccagaccgugaaggacacccccaucagcaccacccacaccagccugcccagcacccccagcgccaccaccaccccccagggcacccaccacaccgccagaggccugcugagcgugaccagcaccaagcccgagggcgccagcacccaggccaaccccgagaagaucagcauggagaccaacagccccagacuggccaucagcgagacccccagcuucagccccaccacccaggcccccaccgagaacagcaaccccaucaccagcaagcagcugaucuucagcgcccagcccgugacccccaaccccgugaccccccccgugcagcccgcccugagccagagcgacaccagcaccgccauccaggacauccaccccagccccaccagcagaagcaagagaaaccuggagauggagaucauccugacccugagccagggccugaagaaguacuacggcaagauccugaagcugcuggaccugacccuggaggaggacaccgagggccugcuggaguggugcaagagaaaccugggccuggugugcgacgccgacuucuuccagaagagaaucgaggaguucuuccugaccggcgagggccacuucaacgaggugcugcaguucaagacccccagcacccugagccccaccggccccgccagaaccggcagccccaccguggagcccuucaagagcuacuucgccaagggcuuccugagcauggacagcggcuacuucagcgccaagugcuaccccagagccagcaacagcggccugcagcugaucaacgugacccagcacagcaccagaaucaccgacacccccggccccaaggugaccaaccugaagaccaucaacugcaucaaccugaaggccagcguguucaaggagcacagagagaucgagaucaacgugcugcugccccagguggccgugaaccugagcagcugccacgugcugaucaagagccacgugugcgacuacagccuggacaucgacggccccgugagacugcccagaauccaccacgagggcaccuucauccccggcaccuacaagcuggugaucgacaagaagaacaagcagaacgacagaugcacccugaucaccaacugcgugaucaagggcagagagaucagaaagggccagagcgugcugagacaguacagaaccgagaucaagaucggcaaggccagcagcggcagcagaagacugcugagcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggcagcagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggccaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggcuga

SEQ ID NO: 8771 - RNA, 5052 nt, Artificial Sequence
  derived and/or modified CDS sequence (opt4) from CCHFV(4574-ST-2008)__KR814870.1__GP
augcacacccugcuggugugcuucauccuguaccugcagcugcugggccccggcggcgcccacggccagcccaacgccaccgagcacaacagaaccaacaccaccaccgcccccagcaccagccagagccccaagccccccgugagcaccgcccccccccacgcccuggagagccccaccaucaagagcaccacccccaccagcgagaccgagggcagcggcgagaccaccagcccccccaacaccacccagggccccagccugcccgagaccacccccaagagacccgccaccaccgccaccagcacccccagcaccgacaacaccaacagcaccacccacgugaccgacaacaaccccaccagcaccaucagcaccagccccagcagcagccccagcacccccagcacccccagaggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggccagcaccgagaacgccaaccacagcgcccccagacagagcgagagccccgcccagcccaccaccaccagccugaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgaggacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggugagcaccggcagcagaaagcugcugagcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8772 - RNA, 5052 nt, Artificial Sequence
  derived and/or modified CDS sequence (opt4) from CCHFV(75-ST-2010)__KR814864.1__GP
augcacacccugcuggugugcuucauccuguaccugcagcugcugggccccggcggcgcccacggccagcccaacgccaccgagcacaacagaaccaacaccaccaccgcccccagcaccagccagagccccaagccccccgugagcaccgcccccccccacgcccuggagagccccaccaucaagagcaccacccccaccagcgagaccgagggcagcggcgagaccacccccccccccaacaccacccagggccccagccugcccgagaccacccccgagagacccgccaccaccgccaccagcacccccagcaccgacaacaccaacagcaccacccacgugaccgacaacaaccccaccagcaccaucagcaccagccccagcagcagccccagcacccccagcacccccagaggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggccagcaccgagaacgccaaccacagcgcccccagacagagcgagagccccgcccagcccaccaccaccagccugaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggugagcaccggcagcagaaagcugcugagcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8773 - RNA, 5052 nt, Artificial Sequence
  derived and/or modified CDS sequence (opt4) from CCHFV(37-R-2013)__KR814858.1__GP
augcacacccugcuggugugcuucauccuguaccugcagcugcugggccugggcggcgcccacagacagagcaacgccaccgagcacaacggcaccaacaccaccaccgcccccagcaccagccagagccccaagccccccgugagcaccgcccccccccacgcccccgagaccagcaccaucaagcccaccacccccgccagcgagaccgagggcagcggcgagaccacccccccccccaacaccacccagggccccagcccccccgaggccacccccgagagacccgccaccaccgugaccagcacccccagcaccgacaacaccaacagcaccacccacgccaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaacccccacccugcacaccgccacccaggccagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugaccaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgugaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8774 - RNA, 5052 nt, Artificial Sequence
  derived and/or modified CDS sequence (opt4) from CCHFV(Kashmanov)__DQ211631.1__GP
augcacacccugcuggugugcuucauccuguaccugcagcugcugggccugggcggcgcccacggccagagcaacgccaccgagcacaacggcaccaacaccaccaccgcccccagcaccagccagagccccaagccccuggugagcaccgcccccccccacgcccuggagagcagcaccaucaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgagaucagcagcgaggccagcagccugcacagcgccaugagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaucgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccggcccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcaccaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaacagccugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8775 - RNA, 5052 nt, Artificial Sequence
  derived and/or modified CDS sequence (opt4) from CCHFV(Haskovo-V46/13)__KR092379.1__GP
augcacacccugcuggugugcuucauccuguaccugcagcugcugggccugggcggcgcccacggccagagcaacaccaccgagcacaacggcaccaacaacaccaccgcccccggcaccagccagagccccaagccccacaugagcaccacccccccccacgcccccgagagcagcaccaucaagcccaccacccccaccagcgagaccgagggcagcggcgagaccaccccccccagcaacaccacccagggccccagcccccccgagaccaccagcgagagacccgccaccaccgccaucagcaccagcagcaccgacaacaugaaccccaccagccagaugaccgacaacacccccaccagcaccgugagcaucagccccagcagcagccccagcacccccagcaccccccagggcaugcaccaccccgccagaagccugcugagcgugagcagccccaagaccgccaccacccccacccccaccagccccguggaggugggcagcgagaccagcagccagcacagcgccaugagcagcacccccaccccccacaccgccacccaggugagcaccgagaacaccaaccacagcacccccagacagagcgagcccagcgcccagcagaccacccccagccccaugcccagccccgcccagagcacccugcugaugagcgccgcccccaccgccgugcagaacacccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccauggagcccagccacgccgagcugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaaggccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcugggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagaggcaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugcccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugggcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgccaugugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccaagcuggagcagccccagagcauccugaucgagcacaagggcaccaucaucggcaagcagaacgacaccugcaccgccagagccagcugcuggcuggagagcgugaagagcuucuucuacggccugaagaacaugcugggcagcguguucggcaacuuccugaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8776 - RNA, 5052 nt, Artificial Sequence
  derived and/or modified CDS sequence (opt4) from CCHFV(Min)__KX013481.1__GP
augcacacccugcuggugugcuucauccuguaccugcagcugcugggccugggcggcgcccacggccagagcaacgccaccgagcacaacggcaccaacaccaccaccgcccccagcaccagccagagccccaagccccuggugagcaccgcccccccccacgcccuggagagcagcaccaucaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccugaagaccgccaccacccccacccccaccagccccggcgagaucagcagcgagaccagcagccugcacagcgccaugagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaucgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcaccaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8777 - RNA, 5052 nt, Artificial Sequence
  derived and/or modified CDS sequence (opt4) from CCHFV(Kosovo/9553/2001)__AY675511.1__GP
augcacacccugcuggugugcuucauccuguaccugcagcugcugggccugggcggcgcccacggccagagcaacgccaccgagcacaacggcaccaacaccaccaccgcccccggcaccagccagagccccaagccccccgccagcaccacccccagccacgcccccgagagcagcaccaucaagcugaccacccccaccagcgagaccgagggcagcggcgagaccaccccccccaccagcaccacccagggcagccccccccuggagaccacccccgagagaagcaccaccaccgccaccagcaccagcggcaccgacaacaugaacagcaccacccagaugaccgacaacacccccacccugaccgccagcaccagccccagcagcagccccagcacccccagcaccagccagggccugcacuaccccgugagaagccugcugagcgugagcagccccaagaccgugaccacccccacccccaugagccccggcgagaugagcagcgagaccagcagccagcacagcgccaugagcagaacccccaccccccacaccgccacccaggugagcaccgagaacgccaacagaagcaccagcagacagagcgagagcagcgcccagcccgccacccagagccccgugaccagccccgcccagagcauccugcugaugagcgccacccccaccaccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaucaccggcgagggcuacuucaacgaggugcugcaguucaagacccugagcacccccagccccaccgagcccagccacgccagacugcccaccgccgagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaucaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucaugcccggcaccuacaagaucgugaucgacagaaagaacaagcugaacgacagaugcacccuggugaccaacugcgugaucaagggcagagaggugagaaagggccagagcgugcugagacaguacaagaccgagaucaagaucggcaaggcccccaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucgccagaaugagcaaccaccccaagaccaccauggccuuccuguucugguucagccugggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggccagcaccagcgccguggagauggagacccugcccgccgccaccugggagagagaggaggaccugaccaacuucugccaccaggagugccaggugcccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcccaacgacaccugccccgccaagaccagcugcuggcuggagagcgugaagagcuucuucuacggccugaagaacaugcugggcagcguguucggcaacuucuucaucggcauccugcuguuccuggcccccuucuuccuguggaugcugagcuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8778 - RNA, 5052 nt, Artificial Sequence
  derived and/or modified CDS sequence (opt4) from CCHFV(4495-ST-2008)__KR814869.1__GP
augcacacccugcuggugugcuucauccuguaccugcagcugcugggccccggcggcgcccacggccagcccaacgccaccgagcacaacagaaccaacaccaccaccgcccccagcaccagccagagccccaagccccccgugagcaccgcccccccccacgcccuggagagccccaccaucaagagcaccacccccaccagcgagaccgagggcagcggcgagaccacccccccccccaacaccacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcacccccagaggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggccagcaccgagaacgccaaccacagcacccccagacagagcgagagccccgcccagcccaccaccaccagccugaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggugagcaccggcagcagaaagcugcugagcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagagaugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggcuga

SEQ ID NO: 8779 - RNA, 5052 nt, Artificial Sequence
  derived and/or modified CDS sequence (opt4) from CCHFV(Mamon)__KX013478.1__GP
augcacacccugcuggugugcuucauccuguaccugcagcugcugggccugggcggcgcccacggccagagcaacaccaccgagcacaacggcaccaacaccaccaccgcccccagcaccagccagagccccaagccccuggugagcaccgcccccccccacgcccuggagagcagcaccaucaagcccaccacccccgccagcgagaccgagggcagcggcgagaccacccccccccccaacaucacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgagaucagcagcaagaccagcagccugcacagcgccaugagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugagcgacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccguggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaagaccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8780 - RNA, 5052 nt, Artificial Sequence
  derived and/or modified CDS sequence (opt4) from CCHFV(81-R-2014)__KR814865.1__GP
augcacacccugcuggugugcuucauccuguaccugcagcugcugggccugggcggcgcccacggccagagcaacgccaccgagcacaacggcaccaacaccaccaccgugcccagcaccagccagagccccaagccccuggugagcaccacccccccccacgcccuggagagcagcaccaucaagcccaccacccccaccagcgagaccgagggcagcggcgagaccgccccccugcccaacaccacccagggcccccccccccccgagaccacccccgagagacccgccaccaccgugaccagcacccccagcaccgacaacaccaacagcaccauccacgugaccgacaacaaccccaccagcaccaucagcaccagccccagcagcagccccagcacccccagcaccccccagggcauccaccaccccgccagaagccugcugagcgugagcagccccaagaccgccaccacccccacccccaccagccccggcgagaucaacagcgagaccagcagccugcacagcgccaugagcagaacccccacccugcacaccgccacccaggugagcaccgagaacgccaaccacagcgcccccagacagagcgagagcagcgcccagcccaccaccaccagccugaugaccagccccgcccagagcauccugcugaugagcgccgcccccaccgccauccagaacacccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucggcgaguucuucaugaccggcgagggcuacuucaacgaggugcugcaguucaagacccugagcacccugagccccaccgagcccagccacgccagacugcccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8781 - RNA, 5052 nt, Artificial Sequence
  derived and/or modified CDS sequence (opt4) from CCHFV(5180-R-2011)__KR814874.1__GP
augcacacccugcuggugugcuucauccuguaccugcagcugcugggccugggcggcgcccacagacagagcaacgccaccgagcacaacggcaccaacaccaccaccgcccccagcaccagccagagccccaagccccccgugagcaccgccccccccuacgcccccgagagcagcaccaucaagcccaccacccccgccagcgagaccgagggcagcggcgagaccacccccccccccaacaccacccagggccccagcccccccgaggccacccccgagagacccgccaccaccgccaccagcacccccagcaccgacaacaccaacagcaccacccacgccaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaacccccacccugcacaccgccacccaggccagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagagaucagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8782 - RNA, 5052 nt, Artificial Sequence
  derived and/or modified CDS sequence (opt4) from CCHFV(24-R-2012)__KR814856.1__GP
augcacacccugcuggugugcuucauccuguaccugcagcugcugggccugggcggcgcccacagacagagcaacgccaccgagcacaacggcaccaacaccaccaccgcccccagcaccagccagagccccaagccccccgugagcaccgcccccccccacgcccccgagagcagcaccaucaagcccaccacccccgccagcgagaccgagggcagcggcgagaccacccccccccccaacaccacccagggccccagcccccccgaggccacccccgagagaaccgccaccaccgccaccagcacccccagcaccgacaacaccaacagcaccacccacgccaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaacccccacccugcacaccgccacccaggccagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8783 - RNA, 5052 nt, Artificial Sequence
  derived and/or modified CDS sequence (opt4) from CCHFV(46-ST-2012)__KR814860.1__GP
augcacacccugcuggugugcuucauccuguaccugcagcugcugggccugggcggcgcccacggccagagcaacgccaccgagcacaacggcaccaacaccaccaccgugcccagcaccagccagagccccaagccccuggugagcaccacccccccccacgcccuggagagcagcaccaucaagcccaccacccccaccagcgagaccgagggcagcggcgagaccgccccccugcccaacaccacccagggcccccccccccccgagaccacccccgagagacccgccaccaccgugaccagcacccccagcaccgacaacaccagcagcaccauccacgugaccgacaacaaccccaccagcaccaucagcaccagccccagcagcagccccagcacccccagcaccccccagggcauccaccaccccgccagaagccugcugagcgugagcagccccaagaccgccaccacccccacccccaccagccccggcgagaucaacagcgagaccagcagccugcacagcgccaugagcagaacccccacccugcacaccgccacccaggugagcaccgagaacgccaaccacagcgcccccagacagagcgagagcagcgcccagcccaccaccaccagccugaugaccagccccgcccagagcauccugcugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagacugcccaccguggagcccuucaagagcuacuucgccaagggcuuccugagcguggacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacgccaccuucgugaucugcauccugacccugaccaucugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8784 - RNA, 5052 nt, Artificial Sequence
  derived and/or modified CDS sequence (opt4) from CCHFV(ROS/HUVLV-100)__DQ206448.1__GP
augcacacccugcuggugugcuucauccuguaccugcagcugcugggccugggcggcgcccacagacagagcaacgccaccgagcacaacggcaccaacaccaccaccgcccccagcaccagccagagccccaagccccuggugagcaccgcccccccccacgcccuggagagcagcaccaucaagcccaccacccccgugagcgagaccgagggcagcggcgagaccacccccccccccaacaccacccagggccccagcccccccgaggccacccccgagagacccaccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggugagcaccgagaacgccaaccacagcgcccccagacagagcgagagcagcgcccagcagaccaccaccagccccaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8785 - RNA, 5052 nt, Artificial Sequence
  derived and/or modified CDS sequence (opt4) from CCHFV(Saf)__KX013487.1__GP
augcacacccugcuggugugcuucauccuguaccugcagcugcugggccugggcggcgcccacggccagagcaacgccaccgagcacaacggcaccaacaccaccaccgcccccagcaccagccagagccccaagccccuggugagcaccgcccccccccacgcccuggagagcagcaccaucaagcccaccacccccgccagcgagaccgagggcagcggcgagaccacccccccccccaacaccacccagggccccagcccccccgagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgagaucagcagcgagaccagcagccugcacagcgccaugagcagaaccagcacccuguacaccgccacccaggugagcaccgagaacgccaaccacagcgcccccagacagagcgagagcagcgcccagcccaccaccaccagccccaugaccagccccgcccagagcauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagaagcagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacauccaccacgagggcaccuucauccccggcaccuacaagaucgugaucgacaaggagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuaccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaugaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgugagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8786 - RNA, 5052 nt, Artificial Sequence
  derived and/or modified CDS sequence (opt4) from CCHFV(52-R-2014)__KR814862.1__GP
augcacacccugcuggugugcuucauccuguaccugcagcugcugggccugggcggcgcccacagacagagcaacgccaccgagcacaacggcaccaacaccaccaccgcccccagcaccagccagagccccaagccccccgugagcaccgcccccccccacgcccccgagagcagcaccaucaagcccaccacccccgccagcgagaccgagggcagcggcgagaccacccccccccccaacaccacccagggccccagcccccccgaggccacccccgagagacccgccaccaccgccaccagcacccccagcaccgacaacaccaacagcaccacccacgccaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaacccccacccugcacaccgccacccaggccagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacgugccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccggcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8787 - RNA, 5052 nt, Artificial Sequence
  derived and/or modified CDS sequence (opt4) from CCHFV(Turkey-Kelkit06)__GQ337054.1__GP
augcacaccccccuggugugcuucauccuguaccugcagcugcugugccugggcggcgcccacggccagcugaacgccaccgagcacaacggcaccaacaacaccaccgcccccggcgccagccagagccccaagccccccaugagcaccacccccccccacgcccccgagagcagcaccaucaagcccaccacccccaucagcgaggccgagggcagcggcgagaccaccagcccccccaacaccacccagggccugagcagccccgagaccaccagcgagagacccgccaccaccagcaucagcaccagcagcaccgacagcaccaaccccaccacccagaugaccgacaacacccccacccccaccgugagcaccagccccagcagcagccccagcacccccagcaccccccagggcauccaccaccccgccagaagccugcugagcgugagcagccccaagaccgugaccacccccacccccaccagccccggcgagaugagcagcgagaccagcagccagcacagcgccaugagcagaauccccaccccccacaccgccaccagagugagcaccgagaucaccaaccacagaacccccagacagagcgagagcagcgcccagcagaccacccccagccccaugaccagccccgcccagagcauccugcugaugagcgccgcccccaccgccgugcaggacauccaccccagccccaccaacagaagcaagagaaaccuggagaccgagaucauccugacccugagccagggccugaagaaguacuacggcaagauccugaagcugcugcaccugacccuggagcaggacaccgagggccugcuggaguggugcaagggcaaccugggcagcaacugcgacgacgacuucuuccagaagagaaucgaggaguucuucaugaccggcgagugcuacuucaacgaggugcugcaguucaagacccugagcacccugagccccaccgagcccagccacgccagacugcccaccgccgagcccuucaagagcuacuucgccaagggcuuccugagcaucgacagcggcuacuucagcgccaagugcuaccccagaagcagcgccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcuucagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgagagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggugcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggagccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggcccugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcggcaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggcuga

SEQ ID NO: 8788 - RNA, 5052 nt, Artificial Sequence
  derived and/or modified CDS sequence (opt4) from CCHFV(V42/81)__GU477490.1__GP
augcacacccugcuggugugcuucauccuguaccugcagcugcugggccugggcggcgcccacgugcagcccaacgccaccgagcacaacagaaccaacaccaccaccgcccccggcaccagccacagccugaagccccuggugagcaccacccccccccaggcccccgagagcagcaccaucaagcccaccacccccaccagcgagaccgagggcagcggcgaggccaccccccugagcaacaccauccaggcccccagcagccccgagaccaccagcgagagacccgccaccgccgugaucagcaccagcggcaccgacagcaccaacagcaccacccagaccaccgacaacaaccccaccaccaccgugggcaccagccccagcagcagccccagcacccccagcaccccccagggcauccaccaccacgccagaagccugcugagcgugaccagccccgagaccgugaccacccccaagcccaccagccccagagagaugagcagcgagaccagcaaccagcacagcgccaugagcagaacccccacccaccacaccgugacccaggugagcaccgagaacaccagccacagcacccccagacagcccgagagcagcgcccagcccaccagcagcagccccaugaccagccccgcccagagcacccugcugaugagcgccgcccccaccgccgugcagagcauccaccccagccccaccaacagaagcaagagaaaccuggagaccgagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccccagcaccgugagccccaccgagcccagccacgccagacugcccaccgccgagcccuucaagagcuacuucgccaagggcuuccugagcaucgacagcggcuacuucagcgccaagugcuacagcagaagcagcaccagcggccugcagcugaucaacgugacccagcaccccgccagaaucgccgagacccccggccccaagaccaccagccugaagaccaucaacugcaucaaccugagagccagcguguucaaggagaacagagagaucgagaucagcgugcugcugccccagaucgccgugaaccugagcaacugccacguggugaucaacagccacgugugcgacuacagccuggacaccgacggccccgugagacugcccagaaucaaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcaaggagcccggcgacgacugcaucagcagaacccagcugaugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaaggccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccuggagugcccccacaucccccugcugggcaagcuggccaucuacaucugcagaaugagcaaccaccccagaaccaccauggccuuccuguucugguucggcuucggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggugcugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugcaucgugaagggccugguggacagcgugagcgacagcuucuuccccggccugagcgugugcaagaccugcagcaucagcagcaucaacggcuucgagaucgagagccacaagugcuacugcagccuguucugcugccccuacugcagacacugcagcgccgacagagagauccaccagcugcaccugagcaucugcagaaagagaagaaccggcagcaacgugaugcuggccgugugcaagagaaugugcuucagagccaccaucgaggugagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacauccagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaucgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgagaccccccagcuggaccugaaggccagacccgccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggagagcggcaccgacagcaccuucaaggccuucagcgccaugcccaagaccagccugugcuucuacaucguggagagagaguacugcaagagcugcagcgaggacgacacccagaagugcguggagaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggaggacgaggagaccggcuacagaagaaucaucgagagacugaacagcaagaagggcaagaacagacugcuggacggcgagagacuggccgacagaaagaucgccgagcuguucagcaccaagacccacaucggcuga

SEQ ID NO: 8789 - RNA, 5052 nt, Artificial Sequence
  derived and/or modified CDS sequence (opt4) from CCHFV(75-R-2012)__KR814863.1__GP
augcacacccugcuggugugcuucauccuguaccugcagcugcugggccugggcggcgcccacagacagagcaacgccaccggccacaacggcaccaacaccaccaccgcccccagcaccagccagagccccaagccccuggugagcaccgcccccccccacgcccuggagagcagcaucaucaagcacaccacccccgugagcgagaccgagggcagcggcgagaccacccccccccccaacaccacccagggccccagcccccuggagaccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccugaagaccgccaccacccccacccccaccagccccggcgagaucagcagcgagaccagcagccugcacagcgccaugagcagaaccagcacccuguacaccgccacccaggugagcaccgagaacgccaaccacagcgcccccagacagagcgagagcagcgcccagcagaccaccaccagccccaugaccagccccgcccagagcauccuggugaugagcgccgcccccaccgccauccagaacacccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaaaccugggcagcaacugcgacgacgacuucuuccagaagagaaucgaggaguucuucaugaccggcgagggcuacuucaacgaggugcugcaguucaagacccugagcacccagagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcgcccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccuggugaacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuuccuguacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8790 - RNA, 5052 nt, Artificial Sequence
  derived and/or modified CDS sequence (opt4) from CCHFV(VLG/TI29414)__AY179961.1__GP
augcacacccugcuggugugcuucauccuguaccugcagcugcugggccugggcggcgcccacauccagagcaacgccaccgagcacaacggcaccaacaccaccaccgcccccagcaccagccagagccccaagccccuggugagcaccgcccccccccacgcccuggagagcagcaccaucaagcccaccacccccgugagcgagaccgagggcagcggcggcaccacccccccccccaacaccacccagggccccagcccccccgaggccacccccgagagacccgccaccaccgccaccagcacccccagcaccgacaacaccaacagcaccacccacgugaccgacaacaaccccaccagcaccaucagcaccagccccagcagcagccccagcacccccagcaccccccagggcauccaccaccccgccagaaaccugcugagcgugagcagccccaagaccgccaccacccccacccccaccagccccggcgacaucagcagcgagaccagcagccugcacagcgccaugagcagaaccagcacccuguacaccgccacccaggugagcaccgagaacgccaaccacagcgcccccagacagagcgagagcagcgcccagcagaccaccaccagccccaugaccagccccgcccagcccauccuggugaugagcgccgcccccaccgccauccagaacauccaccccagccccaccaacagaagcaagagaaaccuggagauggagaucauccugacccugagccagggccugaagaaguacuacggcaagauccugaagcugcugcaccugacccuggaggaggacaccgagggccugcuggaguggugcaagagaagccugggcagcaacugcgacgacgacuucuuccagaagagaaucgaggaguucuucaugaccggcgagggcuacuucaacgaggugcugcaguucaagacccugagcacccugagccccaccgagcccagccacgccagaccccccaccguggagcccuucaagagcuacuucgccaagggcuuccugagcaucgacagcggcuacuucagcgccaagugcuaccccagacugagcaccagcggccugcagcugaucaacgugacccagcaccccgccagaaucgccgagacccccggccccaagaccaccagccugaagaccaucaacugcaucaaccugagagccagcguguucaaggagcacagagagaucgagaucaacgugcugcugccccagaucgccgugaaccugagcaacugccacguggugaucaacagccacgugugcgacuacagccuggacaccgacggccccgugagacugccccacaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcagcagaaagcugcugagcgaggagcccggcgacgacugcaucagcagaacccagcugcugagagccgagcccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaacgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcugggaggugggcaccggcugcaccugcugcggcuggaacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcaugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugaucgccgccagcaccagccugauggccagaaagcuggaguucggcaccgacagcaccuucaaggccuucagcgccaugcccaagaccagccugugcuucuacaucgccgagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggcuga

SEQ ID NO: 8791 - RNA, 5055 nt, Artificial Sequence
  derived and/or modified CDS sequence (opt4) from CCHFV__KJ648916.1__GP
augcacaucagccugauguacgccauccugugccugcagcugugcggccugggcgagacccacggcagccacaacgagaccagacacaacaagaccgacaccaugaccacccccggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacgccagcaaggccaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaagggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacaggugggcgaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggcuga

SEQ ID NO: 8792 - RNA, 3495 nt, Artificial Sequence
  derived and/or modified CDS sequence (opt4) from CCHVF(CCHVF 10200)__U39455.2__Gn-NSm-Gc
agcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggc

SEQ ID NO: 8793 - RNA, 3495 nt, Artificial Sequence
  derived and/or modified CDS sequence (opt4) from CCHVF(CCHVF IbAr10200)__AF467768.2__Gn-NSm-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaagggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacaggugggcgaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggc

SEQ ID NO: 8794 - RNA, 3495 nt, Artificial Sequence
  derived and/or modified CDS sequence (opt4) from CCHVF(CCHVF Turkey-Kelkit06)__GQ337054.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgagagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggugcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggagccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggcccugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcggcaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggc

SEQ ID NO: 8795 - RNA, 3498 nt, Artificial Sequence
  derived and/or modified CDS sequence (opt4) from CCHVF(CCHVF SR3)__AJ538199.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacaagugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucgugaugugcauccugaagggcgaguucgccgccgugaagagcauccaccccaucgagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcaacaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8796 - RNA, 3498 nt, Artificial Sequence
  derived and/or modified CDS sequence (opt4) from CCHVF(CCHVF UCCR4413)__KY484038.1__Gn-NSm-Gc
agcgagagcagcgccagcggcugcaucagcagaacccagaugaucaagagcgagaccgccgagauccacgacgacaucuacggcggccccggcgagaagcugaccaucugcaacggcaccaccgugguggaccagagacugggcagcgagcugggcugcuacaccaucaacagaaucaagaccuacaagcugugcgagaacagcgugaaggagaagaccugcgagaucgacagcgugcccgugaagugcagacagggccugugccugaagaucacccaggagggcagaggccacgugaagcugagcagaggcagcgagaucgugcuggacaucugcgacagcagcugcgagcugaugauccccaagggcaccggcgacauccugguggacugcagcggcggccagcagcacuuccugcaggacaaccugguggaccugggcugccccaacaucccccugcugggcaagguggccaucuacaucugcagaaugagcaaccaccccaagaccaccauggccuuccuguucugguucagcuucggcuacgugaucaccugcauccugugcaagauccuguucuaccugcugaucaucaccggcacccugggcaagaagcugaagcaguacagagagcugaagccccagaccugcaccaucugcgagagcacccccgugaacgccaucgacgccgagaugcacgaccugaacugcagcuacaacaucugccccuacugcgccagcagacugaccagcgacggccugaucagacacgugaaccugugccccaagagaaaggagaagguggaggagaccgagcuguaccugaaccuggagagaauccccugguucgugagaaagcugcugcaggugagcgagagcaccggcguggcccugaagagaagcagcuggcugcugauccuggugauccugcugaccgugagcaugagccccgugcagagcgcccccaucaaccagcagagagccguggaggccuaccaggccagagagggcuacaccggcaucugccuguucauccugggcagcgugcuguucaugaccagcuggcugaccaagggccugaucgacagcaucggcgacagcuucuuccccggccuguucgugugcaagaccugcagcaucggcagcaucaacggcuucgagaucgagagccacagaugcuacugcagccugcugugcugccccuacugcagaaccugcagcgccgacaaggacagccaccagcugcaccugagcaucugcaagaagaagaaggccggcagcaacgugaugcuggccgugugcaagagaaugugcuucaaggccaccaucgaggccagcaacagagugcugcugaucagaagcaucaucaacaccaccuucaucaucugcaugcugauccugguggugugcgugaucagcaccagcgccguggagauggaggaccugcccgccggcaccugggagagagaggaggaccugaccaacuucugccaccaggagugccaggugaccgagaccgagugccugugccccuacgaggccuucgugcugagaaagccccuguuccugagcagcaucgugaagggcaagaagaaccugcugaacagcgccagccuggagaccagccugagcaucgaggcccccuggggcgccaucaacgcccagagcaccuucaagcccaccaucagcaccgccaacaucgcccugagcuggagcagcguggagcacagaggcaacaaggugcuggugagcggcagaagcgagagcaucaugaagcuggaggagagaaccggcaucagcuggaaccugggcguggaggacgccagcgagagcagaaugcugaccgugagcgugauggaccugagccagauguaccugcccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugcccagcgagaucgugacccugcaccccaagaucgaggagggcuucuucgaccugaugcacgugcagaaggugcugagcgccagcaccgugugcaagcugcagagcugcacccacggcguggccggcgaccugcagguguaccacgugggcaaccugcugaagggcgacaagaucaacggccacagcauccacaagaucgagccccaccugaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagagcuuccacuuccacagcaagagagugaccgcccacggcgacaccccccagcuggaccugaaggccagacccauguacggcgccggcgagaucaccgugcugguggagguggccgacauggagcugcacagcaagaacaucgagaucagcggccugaaguucgccagccugaccugcagcggcugcuacgccugcagcagcggcaucagcugcaaggugagaauccacguggacgagcccgacgagcuggccgugcacgugaagagcgacgaccuggacgugguggccgccagcagcagccugauggccagaaagaucgaguucggcaccgacagcaccuucaaggccuucagcagcaugcccaaggagagccugugcuucuacaucguggagagagacuucugcaagagcugcgccgccgaggacacccagaagugcgugaaggccaagcuggagcagccccagagcauccugaucgagcacaagggcaccaucaucggcaagcagaacgacaccugcagcaccaagaccagcugcuggcuggagagcuucaagagcuucuucuacggccugaagaacaugcugagcggcguguucggcagcgccaucaugggcauccugcuguuccuggcccccuucauccugcugauccuguucuucuucuucggcuggagaauccuguucugccugagaugcugcagaagaaccagaggccuguucaaguacaagcacaucaaggacgacgaggaggccggcuacaagaagaucaucgagaagcugaacaacaagaagggcggcaccagcaagcugcuggacggcgagagacuggccgacagaaagaucgccgagcuguucagcaccaaggcccacaucggc

SEQ ID NO: 8797 - RNA, 3495 nt, Artificial Sequence
  derived and/or modified CDS sequence (opt4) from CCHVF(CCHVF 66019)__AB069669.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaacacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgaggccuaccagaccagagagggcuacaccagcgugugccuguucaugcugggcggcauccuguucguggugagcugccugaugaagggccugguggacagcgugagcaacagcuucuuccccggccugagcaucugcaagaccugcagcaucggcagcgugaacggcuucgagaucgagagccacaagugcuacugcagccugcugugcugccuguacugcagacacugcagcgccgacagagagauccaccagcugcaccugagcaucugcaagaagagaagagccggcggcaacgugaugcuggccgugugcaagagaaugugccugagagccaccauggaggugagcaacaaggugcuguucaucagaagcaucaucaacaccaccuucgugaucugcauccuggugcuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcaacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 8798 - RNA, 3495 nt, Artificial Sequence
  derived and/or modified CDS sequence (opt4) from CCHVF(CCHVF 7001)__AB069670.1__Gn-NSm-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcaaggagagagccaucgagaccuaccaggccagagagaccuacaccggcaucugccuguucgugcugggcagcgugcuguucgccgugagcuggcugaccaaggcccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacaacaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 8799 - RNA, 3495 nt, Artificial Sequence
  derived and/or modified CDS sequence (opt4) from CCHVF(CCHVF 75024)__AB069671.1__Gn-NSm-Gc
agcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucggccacggcaagaccaucgagaccuaccaggccagagaggaguacaccagcaucugccuguucgugcugggcagcauccuguucaucgugagcugccugaugaagggccugguggacagcaucggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugagaggcaugaagaaccagcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaaccuguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8800 - RNA, 3495 nt, Artificial Sequence
  derived and/or modified CDS sequence (opt4) from CCHVF(CCHVF 7803)__AB069672.1__Gn-NSm-Gc
agcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgaggugauccuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucagccacggcaagaccaucgagaccuaccaggccagagaggaguacaccagcaucugccuguucgugcugggcagcauccuguucaucgugagcugccugaugaagggccugguggacagcaucggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgccugcaagagaaugugcuucagagccaccauggaggugagcaacaaggcccugcugaucagaagcaucaucaacaccaccuucgugguguacauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugagaggcaugaagaacccccugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccagaggcaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8801 - RNA, 3495 nt, Artificial Sequence
  derived and/or modified CDS sequence (opt4) from CCHVF(CCHVF 79121)__AB069673.1__Gn-NSm-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagggccugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcaaggagagagccaucgagaccuaccaggccagagagaccuacaccggcaucugccuguucgugcugggcagcgugcuguucgccgugagcuggcugaccaaggcccugaucgacggcaucggcaacagcuucagccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacagcaccgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagaucuaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaaccuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 8802 - RNA, 3495 nt, Artificial Sequence
  derived and/or modified CDS sequence (opt4) from CCHVF(CCHVF 8402)__AB069674.1__Gn-NSm-Gc
agcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8803 - RNA, 3495 nt, Artificial Sequence
  derived and/or modified CDS sequence (opt4) from CCHVF(CCHVF 88166)__AB069675.1__Gn-NSm-Gc
agcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccuggagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgaccugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8804 - RNA, 3495 nt, Artificial Sequence
  derived and/or modified CDS sequence (opt4) from CCHVF(CCHVF BA88166)__AF338470.1__Gn-NSm-Gc
agcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaagggcaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccuggagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguaccuggacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaucaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8805 - RNA, 3495 nt, Artificial Sequence
  derived and/or modified CDS sequence (opt4) from CCHVF(CCHVF BA66019)__AF350448.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaagcaccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgaggccuaccagaccagagagggcuacaccagcgugugccuguucaugcugggcggcauccuguucguggugagcugccugaugaagggccugguggacagcgugagcaacagcuucuuccccggccugagcaucugcaagaccugcagcaucggcagcgugaacggcuucgagaucgagagccacaagugcuacugcagccugcugugcugccuguacugcagacacugcagcgccgacagagagauccaccagcugcaccugagcaucugcaagaagagaagagccggcggcaacgugaugcuggccgugugcaagagaaugugccugagagccaccauggaggugagcaacaaggugcuguucaucagaagcaucaucaacaccaccuucgugaucugcauccuggugcuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 8806 - RNA, 3495 nt, Artificial Sequence
  derived and/or modified CDS sequence (opt4) from CCHVF(CCHVF BA8402)__AF350449.1__Gn-NSm-Gc
agcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaacagcuucaaccugugcgagaacaccgccaccggcaagagcugcgagaucgacagcacccccgugaagugcagacagggcuucugccugaagaucacccaggagggcagaggccacgugaagcugagcagaggcagcgagguggugcuggacgccugcgagagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacccaccagcgacggccuggccagacacgugaugcagugccccaagagaaaggagaagaucgaggagaccgcccuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccugcacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8807 - RNA, 3495 nt, Artificial Sequence
  derived and/or modified CDS sequence (opt4) from CCHVF(CCHVF Matin)__AF467769.2__Gn-NSm-Gc
agcgaggagagcggcgacgacugcaucagcagaacccagcugcugagaaccgagaccgccgagauccacagcgacagcuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaucagagagggcuacaccagcgugugccuguucgugcugggcagcauccuguucaucgugagcugccugaugaagggccugguggacagcgacggcaacagcuucuuccccggccugagcaucugcaagaccugcagcaucggcagcaucaacggcuucgagaucgagagccacaagugcuacugcagccuguucugcugccccuacugcagacacugcagcaccgacagagagauccacaagcugcaccugagcaucugcaagaagagaaagaccggcagcaacgugaugcuggccgugugcaagagaaugugcuucagagccaccguggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaucaacuucugccaccaggagugccaggugaccgagaccgagugccugugccccuacgaggcccuggugcugagaaagccccuguuccuggacagcaucaucaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggugaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugagcaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucgcccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacgugggc

SEQ ID NO: 8808 - RNA, 3495 nt, Artificial Sequence
  derived and/or modified CDS sequence (opt4) from CCHVF(CCHVF Baghdad 12)__AJ538197.2__Gn-NSm-Gc
agcgaggagagcggcgacgacugcaucagcagaaccagacugcugagaaccgagaccgccgagauccacggcgacagcuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcaagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcuggccgugagcagcagccccgugcagagcgcccccaucggcuacggcaagaccaucgagaccuaccaggccagagagggcuacaccagcaucugccuguucgugcugggcagcauccuguucaucgugagcugccugaccaagggccugguggacagcaucggcaacaucuucuuccccggccugagcaucugcaagaccugcagcaucggcagcaucaacggcuucgagguggagagccacaagugcuacugcagccugcugugcugccccuacugcagacacugcagcgccgacagagagauccaccagcugcaccugagcaucugcaagaagagaaagaccggcagcagcgugaugcuggccgugugcaagagaaugugcuucagagccaccauggaggugagcaacaaggcccugcugaucagaagcaucaucaacaccaccuucguggugugcauccugacccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgacgccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggugagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8809 - RNA, 3495 nt, Artificial Sequence
  derived and/or modified CDS sequence (opt4) from CCHVF(CCHVF VLG/TI29414)__AY179961.1__Gn-NSm-Gc
agcgaggagcccggcgacgacugcaucagcagaacccagcugcugagagccgagcccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaacgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcugggaggugggcaccggcugcaccugcugcggcuggaacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcaugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugaucgccgccagcaccagccugauggccagaaagcuggaguucggcaccgacagcaccuucaaggccuucagcgccaugcccaagaccagccugugcuucuacaucgccgagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8810 - RNA, 3495 nt, Artificial Sequence
  derived and/or modified CDS sequence (opt4) from CCHVF(CCHVF TADJ/HU8966)__AY179962.1__Gn-NSm-Gc
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugaagaucacccaggagggcagaggccacgugaagcugagcagaggcagcgagguggugcuggacgccugcgacagcagcugcgaggugaugauccccaagggcaccggcgacaucagcguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccagaauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagagaguggaggagaccgagcuguaccugaaccuggagagaauccccuggaucgugagaaagcugcugcaggugagcgagagcaccggcguggcccugaagagaagcagcuggcugaucgugcugcuggugcuguucaccgugagccugagccccgugcagagcgcccccaucggcuacggcaacaccaucgagaccuaccaggccagagaggaguacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcaucgugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaacccccugaacagcaccagccuggagaccagccugagcaucgaggcccccuggggcgccaucaacgugcagagcaccuacaagcccaccgugagcaccgccaacaucgcccugagcuggagcagcaucgagcacagaggcaacaacauccuggugagcggcagaagcgagagcaucaugaagcuggaggagagaaccggcaucagcggcgaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaucgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggagaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacagaaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccugagcugcuucaagugcugcagaagaaccagaggccugcugaagcacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8811 - RNA, 3495 nt, Artificial Sequence
  derived and/or modified CDS sequence (opt4) from CCHVF(CCHVF Hodzha)__AY223476.1__Gn-NSm-Gc
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcaagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggccagagaggacuacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagagaaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8812 - RNA, 3495 nt, Artificial Sequence
  derived and/or modified CDS sequence (opt4) from CCHVF(CCHVF Kosovo/9553/2001)__AY675511.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucgccagaaugagcaaccaccccaagaccaccauggccuuccuguucugguucagccugggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggccagcaccagcgccguggagauggagacccugcccgccgccaccugggagagagaggaggaccugaccaacuucugccaccaggagugccaggugcccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcccaacgacaccugccccgccaagaccagcugcuggcuggagagcgugaagagcuucuucuacggccugaagaacaugcugggcagcguguucggcaacuucuucaucggcauccugcuguuccuggcccccuucuuccuguggaugcugagcuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8813 - RNA, 3495 nt, Artificial Sequence
  derived and/or modified CDS sequence (opt4) from CCHVF(CCHVF SPU41/84)__AY900142.1__Gn-NSm-Gc
agcgaggagagcagcgacgacugcaucagcagaacccagcugcugagaaccgagaccgccgagauccacggcgacaacuacggcggccccggcgacaagaucaccaucugcaacggcagcaccgugguggaccagagacugggcagcgagcugggcugcuacaccaucaacagagugaagaccuucaagcugugcgagaacagcgccaccggcaagagcugcgagaucgacagcgugcccgugaagugcagacagggcuacugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucaucugcaaggugaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagccacggcaagaccguggaggccuacagagccagagagggcuacaccagcaugugccuguucgugcugggcagcgugcuguuccuggugagcugccugaugaagggccugguggacagcgugggcaacaccuucuuccccggccugagcaucugcaagaccugcagcaucagcagcaucaacggcuucgagaucgagagccacagaugcuacugcagccuguucugcugccccuacugcagacacugcagcgccaacaaggagauccaccagcugcaccugagcaucugcaagaagagaaaggccggcagcaacgugaugcuggccgugugcaagagaaugugcuucagagccaccauggaggugagcaacagagcccuguucaucagaagcaucaucaacaccaccuucgugcugugcauccugauccuggccgccugcguggugagcaccagcgccguggagauggagagccugcccgccggcaccugggagagagaggaggaccugaccaacuucugccaccaggagugccagguggccgacaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccuggugcacaagaucgagccccacuucaacaccagcuggaugagcugggacggcugcgaccuggacuacuacugcaacaugggcgacuggcccagcugcaccuacaccggcgugacccagcacaaccacgccagcuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucaccagccugaccugcaccggcugcuacgccugcagcagcggcaucagcugcaaggugagaauccacguggacgagcccgacgagcugaccgugcacgugaagagcgaggaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagagaaagggcaccaucaucggcaagcagaacaacaccugcaaggccaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaagaaucgccgagcuguucagcaccaagacccacaucggc

SEQ ID NO: 8814 - RNA, 3495 nt, Artificial Sequence
  derived and/or modified CDS sequence (opt4) from CCHVF(CCHVF UG3010)__AY900143.1__Gn-NSm-Gc
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcaucgugugcaaggugcuguucuaccugcugaucgugaucggcacccugagcaagaagcugaagcaguacagagagcugaagccccagaccugcaucgugugcgagagcacccccgugaacgccaucgacgccgagaugcacgagcugaacugcaacuacaacaucugccccuacugcgccagcagacugaccagcgacggccuggugagacacgugaaccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggccagggcaaggccguggagguguacagagugagagagagcuacaccagcaucugccuguucgugcugggcagcgugcuguucgccgugagcuggcugaucaagggccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaucacccacagaaugcaccugaacgugugcaagaagagaaaggccggcagcaacgugaugcuggccgugugcaagagaaugugcuucaaggccaccguggaggccagcaacaccgcccugcugaucagaggcaucaucaacagcaccuucgugaucugcgugcugauccuggugaucugcguggugagcaccagcgccguggacauggagaaccugcccgccggcaucugggagagagaggaggaccugaccaacuucugccaccaggagugccaggugaccgagaccgagugccugugccccuacgaggcccugauccugagaaagccccuguaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccaggagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacauccagcagagacugcccagcgagaucgugacccugcaccccaagaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcagcgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccaacgacgacacccagaagugcguggacaccaagcuggagcacccccagagcauccugaucgagcacaagggcaccaucaucggcaagcagaacgacaccugcagcaccaagaccagcugcuggcuggagagcgugaagagcuucuucuacggccugaagaacaugcugggcggcaucuucggcaacguguuccugggcaucuuccuguuccuggcccccuucgcccugcugaucuucuucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggc

SEQ ID NO: 8815 - RNA, 3495 nt, Artificial Sequence
  derived and/or modified CDS sequence (opt4) from CCHVF(CCHVF Hy13)__AY900145.1__Gn-NSm-Gc
agcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggcagcagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggccaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8816 - RNA, 3495 nt, Artificial Sequence
  derived and/or modified CDS sequence (opt4) from CCHVF(CCHVF Semunya)__DQ094832.1__Gn-NSm-Gc
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcguggugugcaaggugcuguucuaccugcugaucgugaucggcacccugggcaagaagcugaagcaguacagagagcugaagccccagaccugcaucgugugcgagagcauccccgugaacgccaucgacgccgagaugcacgagcugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggccaggagaaggccaucgagguguaccaggugagagagagcuacaccagcaucugccuguucgugcugggcagcgugcuguucgccgugagcuggcuggugaagggccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaucacccacagaaugcaccugaacaucugcaagagaagaaaggugggcagcaacgugaugcuggccgugugcaagagaaugugcuucaaggccaccguggaggccagcaacagcgcccugcugaucagaagcaucaucaacagcaccuucgugaucugcgugcugauccuggugaucugcguggugagcaccagcgccguggacauggagaaccugcccgccggcaucugggagagagaggaggaccugaccaacuucugccaccaggagugccaggugaccgagaccgagugccugugccccuacgaggcccugauccugagaaagccccuguuccuggacagcaucgccaagggcaagaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacgugcagcagagacugcccagcgagaucgugacccugcaccccaagaucgaggagggcuucuucgaccugaugcacgugcagaaggugcuguucugcaaguacagccugcaggccaccagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucgugaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccgacgacgacacccagaagugcgugaacaucaagcuggagcacccccagagcauccugaucgagcacaagggcaccaucaucggcaagcagaacgacaccugccccaccaagaccagcugcuggcuggagagcgugaagagcuucuucuacggccugaagaacaugcugggcggcaucuucggcaacguguuccugggcaucuuccuguuccuggcccccuucgcccugcugauccuguucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccaagcuguucagcaccaagacccacaucggc

SEQ ID NO: 8817 - RNA, 3495 nt, Artificial Sequence
  derived and/or modified CDS sequence (opt4) from CCHVF(CCHVF SPU128/81/7)__DQ157174.1__Gn-NSm-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgagagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaucggcaucuuccuguuccugggccccuucauccugcugauccuguucuucauguucggcuggagaauccuguucugcuucaagugcugcagaagaaccagaggccugcugaaguacagacaccugaaggaggacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8818 - RNA, 3495 nt, Artificial Sequence
  derived and/or modified CDS sequence (opt4) from CCHVF(CCHVF ROS/HUVLV-100)__DQ206448.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8819 - RNA, 3495 nt, Artificial Sequence
  derived and/or modified CDS sequence (opt4) from CCHVF(CCHVF AP92)__DQ211625.1__Gn-NSm-Gc
agcgagggcggcgacggcggcugcaucagcagaacccagcugaucaagaccgagaccgccgaggugcacggcgacgacuacggcggccccggcgagaagaucaccaucugcaacggcagcaccaucguggaccagagacugggcagcgagcugggcugcuacaccaucaacagaaucaagagcuucaagcugugcgagaacagcgcccagggcaagaacugcgagaucgacagcgcccccgugcagugcagacagggcuacugccugaagaucagccaggagggcagaggccacgugaagcugagcagaggcagcgagaucgugcuggacgugugcgacaccagcugcgagaucaugauccccaagggcaccggcgacauccugguggacugcagcggcggccagcagcacuuccugcagagcaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaagacccuguucuacauccugaucaucaucggcacccugggcaagaagcugaagcaguacagagagcugaagccccagaccugcaccaucugcgagagcgugcccgugaacgccaucgacgccgagaugcacgaccugaacugcagcuacaacaucugccccuacugcgccagcagacugaccagcgagggccugaccagacacgugaaccagugccccaagagaaaggagaagguggaggagaccgagcuguaccugaaccuggagagaauccccuggaucgugagaaagcugcugcaggugagcgagagcaccggcguggcccugaagagaagcagcuggaugaucgugcugcugauccugcugaucgugagcaugagccccgugcagagcgcccccaucagccaggagagaaccguggcccuguaccagagcagagaggacuacaugggcaucugccuggugaucaugggcagcgugcugcuggccgugagccugcuggugagaggccugaucgacagcaucagcagcaccuucuuccccggccugagcgugugcagaaccugccacaucggcagcaucaacggcuucgagaucgagagccacaagugcuacugcggccugcugugcugccccuacugcagagccugcagcaccgaccaggacgcccaccaguuccaccugagcgugugcaagaagagaaaggccggcagcaacgugaugcuggccgugugcaagagaaugugcuucaaggccaucaucgaggccagcaacaaggugcuguucaucagaaacgugaucaacaccaccuucguggugugcauccuggugaugguggccugcaucgccagcagcgccgccguggagauggagaaccugcccgccggcaccugggagagagaggaggagcugaccaacuucugccaccaggagugccaggugaccgagaccgagugccugugccccuacgagagcuucauccugagaaagccccuguuccuggacagcaucgccaagggcgugaagaaccugcugaacagcaccagccuggagaccagccugagcaucgaggcccccuggggcgccaucaacgcccagagcaccuacaagcccaccgccagcagcgccaacaucgcccugaccuggagcagcguggagcacagaggcaacaagauccuggugagcggcagaagcgagagcaucaugaagcuggaggagagaaccggcaucagcuggaaccugggcguggaggacgccagcgagagcagaacccugaccaucagcgugauggaccugagccagauguacagccccguguucgaguaccugagcggcgacagacagguggaggaguggcccaaggccaccugcaccggcaacugccccgagagaugcggcugcaccagcagcaccugccuguacaaggaguggccccacagcagaaacuggagaugcaaccccaccuggugcuggggcgugggcaccggcugcaccugcugcggccuggacgugaaggagcuguucaccgaccacaugcuggugaaguggaagguggaguacaucaagaccgaggccaucgugugcguggagcugaccagccaggagagacagugcagccugaucgaggccggcaccagauucagccugggccccgugaccaucacccugagcgagcccagaaacauccagcagaagcugccccccgagcugaucacccugcaccccaagaucgaggacggcuacuucgaccugaugcacgugcagaaggugaugagcgccagcaccgugugcaagcugcagagcugcacccacggcgugcccggcgaccugcagaucuaccacgugggcaaccugcugaagggcgacagagugaacggccaccugauccacaagguggagccccaccugaacaccagcuggaugagcugggacggcugcgaccuggacuacuucugcaacaugggcgacuggcccagcugcaccuacaccggcgugacccagcacaaccacgccgccuucgccaaccugcugaacaucgagaccgacuacaccaagaccuuccacuuccacagcaagagagugaccgcccacggcgacaccccccagcuggaccugaaggccagacccagauacggcgccggcgagaucaccgugcugguggagguggccgacauggagcugcacaccaagaagguggaggugaccggccugaaguucgccagccugaccugcagcggcugcuacgccugcagcagcggcaucagcugcaaggugagaauccacguggacgagcccgacgagcugaccgugcacgugaagagcagcgaccccgacaucguggccgccagcagcagccugauggccagaaagaucgaguucggcguggacagcaccuucaaggccuucagcagcaugcccaaggacagccugugcuucuacaucguggagagagacuacugcaacagcugcaagaacgaggagacccagagaugcgugaacgccaagcuggagcagccccagagcauccugaucgagcacaccggcaccaucaucggcaagcagaacgacaccugcggcagcagaaccagcugcuggcuggacagcuucaagagcuucuucuacggccugaagagcaugcugagcggcaucuucggcaacguguuccugggcaucuuccuguuccuggcccccuucgcccugcugcuguucuucuucuucuucggcuggagaauccuguucugcuucaagugcugcagaagaaccagaggccuguucaaguacagacacaucaaggacgacgaggaggugggcuacaagaagaucaucgagagacugaacaacaagaagggcaagcacagacugcuggacggcgagagacuggccgacagaaagaucgccgagcuguucagcaccaagacccacaucggc

SEQ ID NO: 8820 - RNA, 3495 nt, Artificial Sequence
  derived and/or modified CDS sequence (opt4) from CCHVF(CCHVF ArD8194)__DQ211626.1__Gn-NSm-Gc
gccgagggcggcagcaacgacugcgugagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugagaaccuacaagcugugcgagaacagcgccaccgagaagagcugcgagaucgacagcgugcccgugaagugcaagcagggcuucugccugaagaucacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacaucccccugcugggcagaaccgccaucuacgugugcagaaugagcaaccaccccaagaccaccauggccuuccuguucugguucagcuucggcuacgugaucaccugcguggugugcaaggugcuguucuaccugcugaucgugaucggcacccugggcaagagacugaagcaguacagagagcugaagccccagaccugcaucgugugcgagagcauccccgugaacgccaucgacgccgagaugcacgaccugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaaagcugcugcaggugagcgagagcaccggcguggcccugaagagaagcugcuggaugaucacccugcugauccugcugaccgugagcaugagccccgugcagagcgcccccgugggccacaagagagccguggagguguaccagaugagagagagcuacaccggcaucugccuguucgugcugggcagcgugcuguucgccgugagcuggcuggugaaggcccugaucgacagcaucggcaacagcuucuuccccggccugagcaucugcaagaccugcagcaucggcagcaucaacggcuucgagaucgagagccacaagugcuacugcagccuguucugcugccccuacugcagagccugcagcagcgacaagaucacccacagaaugcaccugaacgugugcaagaagagaaaggugggcagcaacgugaugcuggccgugugcaagagaaugugcuucaaggccaccaucgaggccagcaacagagccaccuucaucagaaacaucaucaacagcaccuucgugaucugcauccugauccuggugaucugcguggugagcaccagcgccguggacauggagaaccugcccgccggcaucugggagaaggaggaggaccugaccaacuucugccaccaggagugccaggugaccgagaccgagugccugugccccuacgaggcccugaugcugagaaagccccuguuccuggacagaaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacaagggcaacaagauccuggugagcggcagaagcgagagcaucaugaagcuggaggagagaaccggcaucagcuggugccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacaugcuggugaaguggaagguggaguacaucaagaccgaggccaucaucugcguggagcugaccagccaggagagacagugcagccugaucgaggccggcaccagauucaaccugggccccgugaccaucacccugagcgagcccagaaacgugcagcagagacugccccccgagaucaucacccugcaccccaagaucgaggagggcuucuucgaccugaugcacgugcagaaggugaugagcgccagcaccgugugcaagcugcagagcugcacccacggcgugcccggcgaccugcagguguaccacgugggcaaccugcugaagggcgacaaggugaacggccacagcauccacaagaucgagagccaccugaacaccagcuggaugagcugggacggcugcgaccuggacuacuucugcaacaugggcgacuggcccagcugcaccuacaccggcgugacccagcacaaccacgccgccuucaucaacaugcugaacaucgagaccgacuacaccaagaccuuccacuuccacagcaagagagugaccgcccacggcgacaccccccagcuggaccugaaggccagacccgccuacggcgccggcgagaucaccgugcugguggagguggccgaccuggagcugcacaccaagaagaucgaggugagcggccugaaguucgccagccugagcugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagagcggcgccgacagcaccuucaaggccuucagcagcaugcccaagaacagccugugcuucuacaucguggagagagacuacugcagcagcugcaccgacgacgacacccagaagugcguggacaucaagcuggagcacccccagagcauccugaucgagcacaagggcaccaucaucggcaagcagaacgacaccugccccaccaagaccagcugcuggcuggagagcaucaagagcuucuucuacggccugaagaacaugcugagcggcaucuucggcaacguguuccugggcaugcugcuguuccuggcccccuucauccugcugauccuguucuucuucuucggcuggagacugcuguucugccugaagugcugcagaagaaccagaaagcugcugaaguacaagcaccugagagacgaggaggagagcggcuacaagaagaucaucgagagacugaacgacaagaagggcaagagcagacuguucgacggcgagagacuggccgacagaaagaucgccgagcuguucagcaccaagacccacaucggc

SEQ ID NO: 8821 - RNA, 3495 nt, Artificial Sequence
  derived and/or modified CDS sequence (opt4) from CCHVF(CCHVF ArD15786)__DQ211627.1__Gn-NSm-Gc
gccgagggcggcagcaacgacugcgugagcagaacccagcuggugaagaccgaggugaccgagauccacgaggacagcuacggcggccccggcgagaagaucaccaucugcaacggcagcaccaucguggaccagagacugggcagcgagcugggcugcuacaccaucaacagagugagaaccuacaagcugugcgagaacagcgccaccgagaagagcugcgagaucgacagcgugcccgugaagugcaagcagggcuucugccugaagaucacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacaucccccugcugggccagaccgccaucuacgugugcagaaugagcaaccaccccaagaccaccauggccuuccuguucugguucagcuucggcuacgugaucaccugcguggugugcaaggugcuguucuaccugcugaucgugaucggcacccugggcaagagacugaagcaguacagagagcugaagccccagaccugcaucgugugcgagagcauccccgugaacgccaucgacgccgagaugcacgaccugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaaagcugcugcaggugagcgagagcaccggcguggcccugaagagaagcugcuggaucaucacccugcugauccugcugaccgugagcaugagccccgugcagagcgcccccgugggccacaagagagccguggagguguaccagaucagagagagcuacaccggcaucugccuguucgugcugggcggcgugcuguucgccgugagcuggcuggugaaggcccugaucgacagcaucggcaacagcuucuuccccggccugagcaucugcaagaccugcagcaucggcagcaucaacggcuucgagaucgagagccacaagugcuacugcagccugcugugcugccccuacugcagagccugcagcagcgacaagaucacccacagaaugcaccugaacgugugcaagaagagaaaggugggcagcaacgugaugcuggccgugugcaagagaaugugcuucaaggccaccaucgaggccaacaacagagccaccuucaucagaaacaucaucaacagcaccuucgugaucugcauccugauccuggugaucugcguggugagcaccagcgccguggacauggagaaccugcccgccggcaucugggagaaggaggaggaccugaccaacuucugccaccaggagugccaggugaccgagaccgagugccugugccccuacgaggcccugaugcugagaaagccccugagccuggacagcaucgccaagggcaugaagagccugcugaacagcaccagccuggagaccagccugagcaucgaggcccccuggggcgccaucaacgugcagagcaccuucaagcccaccaucagcgccgccaacaucgcccugagcuggagcagcguggagcacaagggcaacaagauccuggugagcggcagaagcgagagcaucaugaagcuggaggagagaaccggcaucagcuggugccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacaugcuggugaaguggaagguggaguacaucaagaccgaggccaucaucugcguggagcugaccagccaggagagacagugcagccugaucgaggccggcaccagauucaaccugggccccgugaccaucacccugagcgagcccagaaacgugcagcagagacugccccccgagaucaucacccugcaccccaagaucgaggagggcuucuucgaccugaugcacgugcagaaggugaugagcgccagcaccgugugcaagcugcagagcugcacccacggcgugcccggcgaccugcagguguaccacgugggcaaccugcugaagggcgacaaggugaacggccacagcauccacaagaucgagagccaccugaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagagcggcgccgacagcaccuucaaggccuucagcagcaugcccaagaacagccugugcuucuacaucguggagagagacuacugcagcagcugcaccgacgacgacacccagaagugcguggacaucaagcuggagcacccccagagcauccugaucgagcacaagggcaccaucaucggcaagcagaacgacaccugccccaccaagaccagcugcuggcuggagagcaucaagagcuucuucuacggccugaagaacaugcugagcggcaucuucggcaacaucuuccugggcaugcugcuguuccuggcccccuucgugcugcugauccuguucuucuucuucggcuggagacugcuguucugccugaagugcugcagaagaaccagaaagcugcugaaguacaagcaccugagagacgaggaggagagcggcuacaagaagaucaucgagagacugaacgacaagaagggcaagagcagacuguucgacggcgagagacuggccgacagaaagaucgccgagcuguucagcaccaagacccacgugggc

SEQ ID NO: 8822 - RNA, 3495 nt, Artificial Sequence
  derived and/or modified CDS sequence (opt4) from CCHVF(CCHVF ArD39554)__DQ211628.1__Gn-NSm-Gc
agcgagagcaacaacaacgacugcgugagcagaacccagcugaucaagaccgagaacgccgagauccacggcgacgacuacggcggccccggcgagaagaucaccaucugcaacggcagcaccaucguggagcagagacugggcagcgagcugggcugcuacaccaucaacagaaucaagagcuucaagcugugcgagaacagcgccagcggcaagggcugcgagaucgacagcacccccgugaagugcaagcagggcuucugccugaagaucacccaggagggcagaggccacgugaagcugagcagaggcagcgagaucauccuggacgugugcgacagcagcugcgagaugaugauccccaagggcagcggcgacauccugguggacugcagcggcggccagcagcacuuccugcaggacaaccugguggaccugggcugccccaacgugccccugcugggcaagauggccaucuacaucugcagaaugagcaaccaccccaagaccaccauggccuuccuguucugguucagcuucggcuacgugaucaccugcaucuucugcaaggugaucuucuacgugcugaucaucaucggcacccugggcaagagaaucaagcaguacagagagcugaagccccagaccugcaccaucugcgaggccacccccgugaacgccaucgacgccgagaugcacgaccugaacugcagcuacaacaucugccccuacugcgccagcagacugaccagcgagggccuggugagacacgugacccagugccccaagagaaaggagaagaucgaggagaccgagcuguaccugaaccuggagagaauccccugguucgugagaaagcugcugcaggugagcgagagcaccggcguggcccugaagagaagcagcuggcuggugacccugcuggugcugcugaccgugagccugagccccgugcagagcgcccccaucggccaggagagaaccguggugaccuaccaggugagagagagcuacaccggcaugugccuguucauccugggcagcgugcuguucgccaucagcuggcugaccaagggccugguggacagcgugggcaacaucuucuuccccggccugagcgugugcaagaccugcagcaucggcagcaucaacggcuucgagaucgagagccacaagugcuacugcagccuguucugcugccccuacugcagauacugcagcgccgacagaggcgcccaccagagccaccugagcgugugcaagaagagaaagaccggcagcaacgugaugcuggccgugugcaagagaaugugcuucagagccacccugaaggugagcagcgaggcccugaucaucagaagcaucaucaacaccaccuucguggugugcauccugauccugguggugugcguggugagcaccagcgccguggagauggagaaccugcccgccggcaccugggagaaggaggaggaccugaccaacuucugccaccaggagugccaggugaccgagaccgagugccugugccccuacgaggccuucgugcugagaaagccccuguuccuggacagcaccgccaagagcaugaagagccugcugaacagcaccagccuggagaccagccugagcaucgaggcccccuggggcgccaucaacgugcagagcaccuucaagcccaccgccagcaccgccaacaucgcccugagcuggagcagcguggagcacagaggcaacaagauccuggugaccggcagaagcgagagcaucaugaagcuggaggagagaaccggcaucagcuggaaccugggcguggaggacgccagcgagagcaagacccugaccgugagcgugauggaccugagccagauguacagcaccguguucgaguaccugagcggcgacagacagguggaggaguggcccaaggccaccugcaccggcgacugccccgagagaugcggcugcaccagcagcaccugccugcacaaggccuggccccacagcagaaacuggagaugcaaccccaccuggugcuggggcgugggcaccggcugcaccugcugcggccuggacgugaagaaccuguucaccgacuacaugcugaucaaguggaagguggaguucaucaagaccgaggccaucgugugcguggagcugaccagccaggagagacagugcagccugaucgaggccggcaccagauucaaccugggccccgugaccaucacccugagcgagcccagaaacauccagcagaagcugccccccgagcuggugacccugcaccccagaguggaggagggcuucuucgaccugaugcacgugcagaaggugcugagcgccagcaccgugugcaagcugcagagcugcacccacggcgugcccggcgaccugcagguguaccacgugggcaaccugcugaagggcgacaagaucaacggcaacagcuuccacaagaucgagcccaaccugaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgagaccccccagcuggaccugaaggccagacccaaguacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagacugcacguggacgagcccgacgagcugaccgugcacgugaagagcgacgaccccgacgugguggccgccagcagcagccugauggccagaaagaucgaguucggcaccgacagcaccuucaaggccuucagcagcaugcccaaggacaagcugugcuucuacaucguggagagagacuacugcagcagcugcagcaaggaggacacccagaagugcgugaacgccaagcuggagcagccccagagcauccugaucgagcacaagggcaccaucaucggcaagcagaacgacaccugcaccgugaaggccagcugcuggcuggagagcgugaagagcuucuucuacggccugaagaacaugcugggcggcaucuucggcaacgugauccugggcaucaucauguuccuggcccccuucgcccugcugcugcuguucuuccuguucggcuggagaauccuguucugccugagaugcugcagaagaaccagaggccuguucaaguacaagcacaucaaggacgacgaggagagcggcuacaagagaaucaucgagagacugaacaacaagaagggcaagaacaagcuguucgacggcgagagacuggccgacaagaagaucgccgagcuguucagcaccaagacccacaucggc

SEQ ID NO: 8823 - RNA, 3495 nt, Artificial Sequence
  derived and/or modified CDS sequence (opt4) from CCHVF(CCHVF C-68031)__DQ211629.1__Gn-NSm-Gc
agcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcaucaacggcuucgagaccgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8824 - RNA, 3495 nt, Artificial Sequence
  derived and/or modified CDS sequence (opt4) from CCHVF(CCHVF Drosdov)__DQ211630.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacuacagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugauccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaugaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8825 - RNA, 3495 nt, Artificial Sequence
  derived and/or modified CDS sequence (opt4) from CCHVF(CCHVF Kashmanov)__DQ211631.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcaccaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaacagccugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8826 - RNA, 3495 nt, Artificial Sequence
  derived and/or modified CDS sequence (opt4) from CCHVF(CCHVF Oman)__DQ211632.1__Gn-NSm-Gc
agcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuucugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8827 - RNA, 3495 nt, Artificial Sequence
  derived and/or modified CDS sequence (opt4) from CCHVF(CCHVF SPU97/85)__DQ211633.1__Gn-NSm-Gc
agcgaggagagcgacggcgacugcaucagcagaacccagcugcugagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcagcugcgagaucaugauccccaagggcaccggcgacauccugguggacugcagcggcggccagcagcacuuccugaaggacaaccugaucgaccugggcugccccaacaucccccugcugggcagaauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucaucgugagcugccuggugaagggccugaucgacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccaucgaggugagcaacagagcccugcugaucagaagcaucaucaacaccaccuucgccgugugcauccugacccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacacccagaagugcgugaacaccaagcuggagagaccccagagcauccugaucgagcacaagggcaccaucaucggcaagcagaacgacaccugcaccgccaaggccagcugcuggcuggagagcgugaagagcuucuucuacggccugaagagcaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 8828 - RNA, 3495 nt, Artificial Sequence
  derived and/or modified CDS sequence (opt4) from CCHVF(CCHVF SPU103/87)__DQ211634.1__Gn-NSm-Gc
agcgaggagagcagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagaccuucaagcugugcgagaacagcgccaccggcaagagcugcgagaucgacagcgugcccgugaagugcagacagggcuacugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcgugcugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaagacugcugcaggugagcgagagcaccggcguggcccugaagagaagcagcuggcugaucgugcugcuggugcuguucaccgugagccugagccccgugcagagcgcccccaucagccacggcaagaccguggaggccuaccaggccagagagggcuacaccggcaugugccuguucgugcugggcagcauccuguuccuggugagcugccugaugaagggccugguggacagcgugggcaacaccuucuuccccggccugagcaucugcaagaccugcagcaucagcagcaucaacggcuucgagaucgagagccacagaugcuacugcagccuguucugcugccccuacugcagacacugcagcgccaacaaggagauccaccagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagagccugcccgccggcaccugggagagagaggaggaccugaccaacuucugccaccaggagugccaggugaccgacaccgagugccugugccccuacgaggcccuggugcugagaagaccccuguuccuggacaacaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagaucgaguacaucaagaccgaggccaucgugugcguggagcugaccagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccuggugcacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucaccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagcacaagggcaccaucaucggcaagcagaacaacaccugcaaggccagagccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaagaaucgccgagcuguucagcaccaagacccacaucggc

SEQ ID NO: 8829 - RNA, 3495 nt, Artificial Sequence
  derived and/or modified CDS sequence (opt4) from CCHVF(CCHVF SPU415/85)__DQ211635.1__Gn-NSm-Gc
agcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucguggugagcugccuggugaagggccugaucgacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccaucgaggugagcaacagagcccugcugaucagaaacaucaucaacaccaccuucguggugugcauccugacccuggccgugugcguggugagcaccagcgccguggagauggagagccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 8830 - RNA, 3495 nt, Artificial Sequence
  derived and/or modified CDS sequence (opt4) from CCHVF(CCHVF Turkey200310849)__DQ211636.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucagcugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgacagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccgccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggc

SEQ ID NO: 8831 - RNA, 3495 nt, Artificial Sequence
  derived and/or modified CDS sequence (opt4) from CCHVF(CCHVF Iran-52)__DQ446215.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacaagugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggaggagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8832 - RNA, 3495 nt, Artificial Sequence
  derived and/or modified CDS sequence (opt4) from CCHVF(CCHVF Iran-53)__DQ446216.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacaagugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8833 - RNA, 3495 nt, Artificial Sequence
  derived and/or modified CDS sequence (opt4) from CCHVF(CCHVF Kosova Hoti)__EU037902.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccagaagggcagaggccacgugaagcugagcagaggcagcgagguggugcuggacgccugcgacagcaacugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccaagaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugaacaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugcccccagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8834 - RNA, 3495 nt, Artificial Sequence
  derived and/or modified CDS sequence (opt4) from CCHVF(CCHVF YL04057)__FJ562094.1__Gn-NSm-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagagagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcaaggagagagccaucgagaccuaccaggccagagagaccuacaccggcaucugccuguucgugcugggcagcgugcuguucgccgugagcuggcugaccaaggcccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacagcaucgccaagggcaagaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcagccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcauccugcuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 8835 - RNA, 3495 nt, Artificial Sequence
  derived and/or modified CDS sequence (opt4) from CCHVF(CCHVF V42/81)__GU477490.1__Gn-NSm-Gc
agcaaggagcccggcgacgacugcaucagcagaacccagcugaugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaaggccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccuggagugcccccacaucccccugcugggcaagcuggccaucuacaucugcagaaugagcaaccaccccagaaccaccauggccuuccuguucugguucggcuucggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggugcugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugcaucgugaagggccugguggacagcgugagcgacagcuucuuccccggccugagcgugugcaagaccugcagcaucagcagcaucaacggcuucgagaucgagagccacaagugcuacugcagccuguucugcugccccuacugcagacacugcagcgccgacagagagauccaccagcugcaccugagcaucugcagaaagagaagaaccggcagcaacgugaugcuggccgugugcaagagaaugugcuucagagccaccaucgaggugagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacauccagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaucgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgagaccccccagcuggaccugaaggccagacccgccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggagagcggcaccgacagcaccuucaaggccuucagcgccaugcccaagaccagccugugcuucuacaucguggagagagaguacugcaagagcugcagcgaggacgacacccagaagugcguggagaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggaggacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8836 - RNA, 3495 nt, Artificial Sequence
  derived and/or modified CDS sequence (opt4) from CCHVF(CCHVF 79121M18)__GU477493.1__Gn-NSm-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagggccugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcaaggagagagccaucgagaccuaccaggccagagagaccuacaccggcaucugccuguucgugcugggcagcgugcuguucgccgugagcuggcugaccaaggcccugaucgacggcaucggcaacagcuucagccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacagcaccgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagaucuaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 8837 - RNA, 3495 nt, Artificial Sequence
  derived and/or modified CDS sequence (opt4) from CCHVF(CCHVF Afg09-2990)__HM452306.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuaccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacaagugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8838 - RNA, 3495 nt, Artificial Sequence
  derived and/or modified CDS sequence (opt4) from CCHVF(CCHVF Sudan Al-Fulah 3-2008)__HQ378184.1__Gn-NSm-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgugaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucagacaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagaaggaguacugcaagagcugcagcgaggaggacaccaagaagugcgugaacaccaagcuggagcagccccagagcauccugaucgagcacaagggcaccaucaucggcaagcagaacagcaccugcaccgccaaggugagcugcuggcuggagagcgccaagagcuucuucuacggccugaaggacaugcugagcggcaucuucggcaacguguucaucggcaucuuccuguuccuggcccccuucgugcugcuggugcuguucuucauguucggcuggagaauccugcugugcuucagaugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaaagaucgccgagcuguucagcaccaagacccacaucggc

SEQ ID NO: 8839 - RNA, 3495 nt, Artificial Sequence
  derived and/or modified CDS sequence (opt4) from CCHVF(CCHVF Sudan AB1-2009)__HQ378187.1__Gn-NSm-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuaccugaucaccugcauccugugcaaggccaucuucuaccugcugaucaucaucggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcaacgaggaggacaccaagaagugcgugaacaccaagcuggagcagccccagagcauccugaucgagcacaagggcaccaucaucggcaagcagaacagcaccugcaccgccagagccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8840 - RNA, 3495 nt, Artificial Sequence
  derived and/or modified CDS sequence (opt4) from CCHVF(CCHVF NIVA 118595)__JN572083.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggugaucuucuaccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcaucgcccugaagagaagcagcuggcugaucgugcugcuggugcuguucaccgugagcaucacccccgugcagagcgcccccaucggccacggcaagaccaucgaggccuacagagccagagaggaguacaccagcaucugccuguucgugcugggcagcgugcuguucguggugagcugccugaugaagggccugguggacagcgugggcaacaucuucuuccccggccuguucaucugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagaaccaccauggaggugagcaacaaggcccuguucgugagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggagagcggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8841 - RNA, 3495 nt, Artificial Sequence
  derived and/or modified CDS sequence (opt4) from CCHVF(CCHVF NIV 112143)__JN572085.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggugaucuucuaccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcaucgcccugaagagaagcagcuggcugaucgugcugcuggugcuguucaccgugagcaucacccccgugcagagcgcccccaucggccacggcaagaccaucgaggccuacagagccagagaggaguacaccagcaucugccuguucgugcugggcagcgugcuguucguggugagcugccugaugaagggccugguggacagcgugggcaacaucuucuuccccggccuguucaucugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccuguucgugagaagcaucaucaacaccaccuucguggugugcauccugauccuggccaucugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8842 - RNA, 3495 nt, Artificial Sequence
  derived and/or modified CDS sequence (opt4) from CCHVF(CCHVF SCT ex Afghanistan)__KC344856.1__Gn-NSm-Gc
agcgaggagagcggcgacgacugcaucagcagaacccagcugcugagaaccgagaccgccgaggugcacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcaagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggugaucuucuaccugcugaucguggugggcacccugggcaagaaguucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaucagcgugugccuguucgugcugggcggcauccuguucguggugagcugccugaucaagggccugguggacagcgugggcaacagcuucuuccccggccugagcaucugcaagaccugcagcaucggcagcgugaacggcuucgagaucgagagccacaagugcuacugcagccugcugugcugccccuacugcagacacugcagcaccgacagagagauccaccagcugcaccugagcaucugcaagaagagaagaaccggcggcaacgugaugcuggccgugugcaagagaaugugcuucagagccaccauggaggugagcaacaaggugcuguucaucagaaacaucaucaacaccaccuucgugaucugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccugaacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagagccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaagcugaacggccacaugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgacaucagcggccugaaguucgccagccugaccugcgccggcugcuacgccugcagcagcggcaucagcugcaaggugagaauccacguggacgagcccgacgagcugaccgugcacgugaagagcgaggaccccgacaucguggccgccagcaccagccugaucgccagaaagcuggagcugggcaccgacagcaccuucaaggccuucagcgccaugcccaagaccagccugugcuucuacaucguggagagagaguacugcaagagcugcagcaaggaggacacccagaagugcgugaacaccaagcuggagcacccccagggcauccugaucgagcacaagggcaccaucaucggcaagcagaacgacaccugcaccgccaaggccggcugcuggcuggagagcgugaagagcuucuucuacggccugaagaacaugcugagcggcaucuucggcaacguguucaucggcaucuuccuguuccuggcccccuucgugcugcugauccuguucuucauguucggcuggagacugcuguucugcuucaagugcugcagaagaaccagaggccuguucaaguacagacaccugaaggaggacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 8843 - RNA, 3495 nt, Artificial Sequence
  derived and/or modified CDS sequence (opt4) from CCHVF(CCHVF Zahedan 2007)__KC867273.1__Gn-NSm-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuucugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccacggcaagaccaucgagaccuacagagugagagaggaguacaccagcaucugccuguucgugcugggcagcauccuguucaucgugagcuuccugaugaagggccugguggacggcgugggcaacaucuucuuccccggccugagcgugugcaagaccugcagcaucggcagcaucaacggcuucgagaucgagagccacagaugcuacugcagccuguucugcugccccuacugcagacacugcagcgccgacggcgagauccaccagcugcaccugagcaucugcaagaagagaaagaccggcagcaacgugaugcuggccgugugcaagagaaugugcuucagagccaccauggaggugagcaacaaggugcuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaaggacaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugaucuucuucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8844 - RNA, 3495 nt, Artificial Sequence
  derived and/or modified CDS sequence (opt4) from CCHVF(CCHVF SPU 44/08)__KJ682805.1__Gn-NSm-Gc
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugagaggccugguggacagcgugagcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 8845 - RNA, 3495 nt, Artificial Sequence
  derived and/or modified CDS sequence (opt4) from CCHVF(CCHVF SPU 383/87)__KJ682806.1__Gn-NSm-Gc
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcuggugguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugauccagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacagacugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucuucggcaagcagaacgacaccugcaccgccaaggccagcugcuggcuggagagcgugaagagcuucuucuacggccugaagaacaugcugagcggcaucuucggcaacguguucaucggcguguuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 8846 - RNA, 3495 nt, Artificial Sequence
  derived and/or modified CDS sequence (opt4) from CCHVF(CCHVF SPU 130/89)__KJ682807.1__Gn-NSm-Gc
agcgaggagcccaacuacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccugagccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagagcacugcaagagcugcagcaaggaggacacccagagaugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcguguuccuguuccuggcccccuucaucauccugauccuguucuucauguucggcuggagaauccuguucugcuucaagugcugcagaagaaccagaggccugcugaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 8847 - RNA, 3495 nt, Artificial Sequence
  derived and/or modified CDS sequence (opt4) from CCHVF(CCHVF SPU 497/88)__KJ682808.1__Gn-NSm-Gc
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcaagggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcggcauccuguuccuggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccuggagcaacgugaugcuggccgugugcaagagaaugugcuucagagccaccguggaggugagcaacaaggcccugcugaucagaaacaucaucaacaccaccuucguggugugcauccugauccuggccaucugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaugagaaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccagagccagcugcuggcuggagagcaucaagagcuucuucuacggccugaagaacaugcugagcggcaucuucggcaacguguucaucggcaucuuccuguucuucgcccccuucaucaugcugauccuguucuucauguucggcuggagaauccuguucugcuucaagugcugcagaagaaccagaggccuguucaaguacagacaccugaaggacgacgaggaggugggcuacagaaagaucaucgagagacugaacaacaagaagggcaagaacaagcugcuggacggcgagagacuggccgacagaaagaucgccgagcuguucagcaccaagacccacaucggc

SEQ ID NO: 8848 - RNA, 3495 nt, Artificial Sequence
  derived and/or modified CDS sequence (opt4) from CCHVF(CCHVF SPU 18/88)__KJ682810.1__Gn-NSm-Gc
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugggcuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagccacggcgagaccguggagguguaccagaccagagagggcuacaccagcaucugccuguucgugcugggcagcauccuguuccuggugagcugccugaugaagggccugguggacagcgugggcaacagcuucagccccggccugagcaucugcaagaccugcagcaucggcagcaucaacggcuucgagaucgagagccacaagugcuacugcagccuguucugcugccccuacugcagacacugcagcgccgacaucgagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagaaccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccggcaaggccggcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaagaacaagaagggcaagaacaagcugcuggacggcgagagacuggccgacagaaagaucgccgagcuguucagcaccaagacccacaucggc

SEQ ID NO: 8849 - RNA, 3495 nt, Artificial Sequence
  derived and/or modified CDS sequence (opt4) from CCHVF(CCHVF SPU 556/87)__KJ682811.1__Gn-NSm-Gc
agcgaggagagcgacggcgacugcaucagcagaacccagcugcugagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcagcugcgagaucaugauccccaagggcaccggcgacauccugguggacugcagcggcggccagcagcacuuccugaaggacaaccugaucgaccugggcugccccaacaucccccugcugggcagaauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucaucgugagcugccuggugaagggccugaucgacagcgugggcaacagcuucuuccccggccugagcaucugcaagaccugcagcaucggcagcgugaacggcuucgagaucgagagccacaagugcuacugcagccuguucugcugccccuacugcagacacugcagcgccgacagagagauccacaagcugcaccugagcaucugcaagaagagaaagaccggcagcaacgugaugagcgccgugugcaagagaaugugcuucagagccaccaucgaggugagcaacagagcccugcugaucagaagcaucaucaacaccaccuucgccgugugcauccugacccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacacccagaagugcgugaacaccaagcuggagagaccccagagcauccugaucgagcacaagggcaccaucaucggcaagcagaacgacaccugcaccgccaaggccagcugcuggcuggagagcgugaagagcuucuucuacggccugaagagcaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 8850 - RNA, 3495 nt, Artificial Sequence
  derived and/or modified CDS sequence (opt4) from CCHVF(CCHVF SPU 431/85)__KJ682812.1__Gn-NSm-Gc
agcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggccacggcaagaccaucgagaccuaccaggccagagagggcuacaccagcuucugccuguucauccugggcagcauccuguucguggugagcugccuggugaagggccugaucgacagcgugggcaacagcuucuuccccggccugagcaucugcaagaccugcagcaucggcagcaucaacggcuucgagaucgagagccacaagugcuacugcagccuguucugcugccccuacugcagacacugccccgccgacagagagauccacaagcugcaccugagcaucugcaagaagagaaagaccggcagcaacgugaugcuggccgugugcaagagaaugugcuucagagccaccaucgaggugagcaacagagcccugcugaucagaaacaucaucaacaccaccuucguggugugcauccugacccuggccgugugcguggugagcaccagcgccguggagauggagagccugcccgccggcaccugggagaaggaggaggaccugaccaacuucugccaccaggagugccaggugaccgagaccgagugccugugccccuacgaggcccuggugcugagaaagccccuguuccuggacagcaucgugaagggcagaaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 8851 - RNA, 3495 nt, Artificial Sequence
  derived and/or modified CDS sequence (opt4) from CCHVF(CCHVF SPU 48/90)__KJ682813.1__Gn-NSm-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgugaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaccaccaccauggccuuccuguucugguucagcuucggcuacgugaucaccugcauccugugcaaggccaucuucuaccugcugaucaucaucggcacccugggcaagagauucagacaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgaggccuacagagccagagagggcuacaccagcaucugccuguucgugcugggcagcauccuguucguggugagcugccugaugaagagacugguggacagcgugggcaacagcuucuuccccggccugagcaucugcaagaccugcagcaucagcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcgacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguucagagacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaacagagccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagaaggaguacugcaagagcugcagcgaggaggacaccaagaagugcgugaacaccaagcuggagcagccccagagcauccugaucgagcacaagggcaccaucaucggcaagcagaacagcaccugcaccgccaaggugagcugcuggcuggagagcgccaagagcuucuucuacggccugaaggacaugcugagcggcaucuucggcaacguguucaucggcaucuuccuguuccuggcccccuucauccugcugauccuguucuucauguucggcuggagaauccugcugugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8852 - RNA, 3495 nt, Artificial Sequence
  derived and/or modified CDS sequence (opt4) from CCHVF(CCHVF SPU 187/90)__KJ682814.1__Gn-NSm-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgaggccuacagagccagagagggcuacaccagcaucugccuguucgugcugggcagcauccuguucguggugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaucuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaagaccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8853 - RNA, 3495 nt, Artificial Sequence
  derived and/or modified CDS sequence (opt4) from CCHVF(CCHVF Haskovo-V46/13)__KR092379.1__Gn-NSm-Gc
agcgaggagcugggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagaggcaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugcccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugggcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgccaugugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccaagcuggagcagccccagagcauccugaucgagcacaagggcaccaucaucggcaagcagaacgacaccugcaccgccagagccagcugcuggcuggagagcgugaagagcuucuucuacggccugaagaacaugcugggcagcguguucggcaacuuccugaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8854 - RNA, 3495 nt, Artificial Sequence
  derived and/or modified CDS sequence (opt4) from CCHVF(CCHVF 24-R-2012)__KR814856.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8855 - RNA, 3495 nt, Artificial Sequence
  derived and/or modified CDS sequence (opt4) from CCHVF(CCHVF 36-ST-2014)__KR814857.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugagcgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaaguuccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggc

SEQ ID NO: 8856 - RNA, 3495 nt, Artificial Sequence
  derived and/or modified CDS sequence (opt4) from CCHVF(CCHVF 37-R-2013)__KR814858.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgugaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8857 - RNA, 3495 nt, Artificial Sequence
  derived and/or modified CDS sequence (opt4) from CCHVF(CCHVF 44-ST-2010)__KR814859.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccugcugugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcuucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugagcgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggc

SEQ ID NO: 8858 - RNA, 3495 nt, Artificial Sequence
  derived and/or modified CDS sequence (opt4) from CCHVF(CCHVF 46-ST-2012)__KR814860.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacgccaccuucgugaucugcauccugacccugaccaucugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8859 - RNA, 3495 nt, Artificial Sequence
  derived and/or modified CDS sequence (opt4) from CCHVF(CCHVF 47-ST-2013)__KR814861.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccuguucaucagaagcaucaucaacaccaccuucgugaccugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgagugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8860 - RNA, 3495 nt, Artificial Sequence
  derived and/or modified CDS sequence (opt4) from CCHVF(CCHVF 52-R-2014)__KR814862.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacgugccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcgugugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaugggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccggcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8861 - RNA, 3495 nt, Artificial Sequence
  derived and/or modified CDS sequence (opt4) from CCHVF(CCHVF 75-R-2012)__KR814863.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcgcccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccuggugaacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuuccuguacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8862 - RNA, 3495 nt, Artificial Sequence
  derived and/or modified CDS sequence (opt4) from CCHVF(CCHVF 75-ST-2010)__KR814864.1__Gn-NSm-Gc
agcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8863 - RNA, 3495 nt, Artificial Sequence
  derived and/or modified CDS sequence (opt4) from CCHVF(CCHVF 81-R-2014)__KR814865.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8864 - RNA, 3495 nt, Artificial Sequence
  derived and/or modified CDS sequence (opt4) from CCHVF(CCHVF 3756-ST-2007)__KR814866.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccugacccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8865 - RNA, 3495 nt, Artificial Sequence
  derived and/or modified CDS sequence (opt4) from CCHVF(CCHVF 3809-ST-2007)__KR814867.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcgugugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcagaagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccugacccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8866 - RNA, 3495 nt, Artificial Sequence
  derived and/or modified CDS sequence (opt4) from CCHVF(CCHVF 3820-ST-2007)__KR814868.1__Gn-NSm-Gc
agcgaggagcccggcgacgacugcaucagcagaacccagcugcugaagaccgagaccgccgagauccacgacgacaacuacggcagccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcuggccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8867 - RNA, 3495 nt, Artificial Sequence
  derived and/or modified CDS sequence (opt4) from CCHVF(CCHVF 4495-ST-2008)__KR814869.1__Gn-NSm-Gc
agcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagaaggaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagagaugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8868 - RNA, 3495 nt, Artificial Sequence
  derived and/or modified CDS sequence (opt4) from CCHVF(CCHVF 4691-ST-2009)__KR814871.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccaggccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaagaaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccgccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8869 - RNA, 3495 nt, Artificial Sequence
  derived and/or modified CDS sequence (opt4) from CCHVF(CCHVF 4701-ST-2009)__KR814872.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcggcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8870 - RNA, 3495 nt, Artificial Sequence
  derived and/or modified CDS sequence (opt4) from CCHVF(CCHVF 5170-R-2011)__KR814873.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8871 - RNA, 3495 nt, Artificial Sequence
  derived and/or modified CDS sequence (opt4) from CCHVF(CCHVF Oman-199809166)__KR864901.1__Gn-NSm-Gc
agcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8872 - RNA, 3495 nt, Artificial Sequence
  derived and/or modified CDS sequence (opt4) from CCHVF(CCHVF 200406546-Turkey)__KR864902.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugaucgaccugggcugcccccacgugccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaaguucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugaccgccagaaagcuggaguucggcaccgacagcaccuucaaggccuucagcgccaugcccaagaccagccugugcuucuacaucguggagaaggaguacugcaagagcugcaacgaggacgacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacaagagaaucaucgagagacugaacaacaagaagggcaagaacagacugcuggacggcgagagacuggccgacagaaagaucgccgagcuguucagcaccaagacccacaucggc

SEQ ID NO: 8873 - RNA, 3495 nt, Artificial Sequence
  derived and/or modified CDS sequence (opt4) from CCHVF(CCHVF 1-CR/HU-2015)__KU161584.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccauggaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8874 - RNA, 3495 nt, Artificial Sequence
  derived and/or modified CDS sequence (opt4) from CCHVF(CCHVF 1231-CR/TI-2015)__KU161585.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggagagcgugagcgacagcuucuuccccggccugagcgugugcagaaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccauggaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8875 - RNA, 3495 nt, Artificial Sequence
  derived and/or modified CDS sequence (opt4) from CCHVF(CCHVF Gaib)__KX013445.1__Gn-NSm-Gc
agcgaggagagcagcgacgacugcaucagcagaacccagcugcugagaaccgagaccgccgagauccacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggccaucuucuaccugcugaucaucgugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacguggugcacugccccaagagaaaggagaagaucgaggagaccgagcuguaccugaaccuggagagagugcccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcggcauccuguucaucgugagcugccugaugaagggccugguggacagcgugggcaacaacuucuuccccggccugaccaucugcaagaccugcagcaucagcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugccugagagugaccaccgaggugagcaacagagcccuguucaucagaagcaucaucaacaccaccuucgugaucugcauccugauccuggccgugugcgugaucagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugagcggcagaagcgagagcaucaugaagcuggaggagagaaccggcaucagcugggaccugggcguggaggacgccagcgagagcagacugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcagagaggacacccagaagugcgugagcaccaagcuggagcagccccagagcauccugaucgagcacaagggcaccaucaucggcaagcagaacaacaccugcaccaccaagaccaccugcuggcuggagagcgugaagagcuucuucuacggccugaagaacaugcugagcagcaucuucggcaacguguucgugggcaucuucagcuuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagagcaagcugcuggacggcgagagacuggccgacagaaagaucgccgagcuguucagcaccaagacccacaucggc

SEQ ID NO: 8876 - RNA, 3495 nt, Artificial Sequence
  derived and/or modified CDS sequence (opt4) from CCHVF(CCHVF Hodzha)__KX013448.1__Gn-NSm-Gc
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccgagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggccagagaggaguacaccagcaucugccuguucgugcugggcagcauccuguucaucgugagcugccugaugaagggccugguggacagcaucggcaacaucuucuuccccggccugaccaucugcaagaccugcagcaucggcagcaucaacggcuucgagaucgagagccacaagugcuacugcagccugcugugcugccccuacugcagacacugccccgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaagaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugcagcgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcagaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8877 - RNA, 3495 nt, Artificial Sequence
  derived and/or modified CDS sequence (opt4) from CCHVF(CCHVF IbAn7620)__KX013451.1__Gn-NSm-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugagaaucacccaggagggcagaggccacgugaagcugagcagaggcagcgagaucgugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaccgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaacccccugaacagcaccagccuggagaccagccugagcaucgaggcccccuggggcgccaucgacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccaacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8878 - RNA, 3495 nt, Artificial Sequence
  derived and/or modified CDS sequence (opt4) from CCHVF(CCHVF K128_76)__KX013454.1__Gn-NSm-Gc
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucagccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccuguucaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccaggacagcaucgugaagggcaugaagaaccugcugaacagcaccagccuggagaccagccugagcaucgaggcccccuggggcgccaucaacgugcagagcaccuacaagcccgccgugagcgccgccaacaucgcccugagcuggagcagcguggagcacagaggcagcaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggagaacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8879 - RNA, 3495 nt, Artificial Sequence
  derived and/or modified CDS sequence (opt4) from CCHVF(CCHVF K168_40)__KX013457.1__Gn-NSm-Gc
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccguggaggugagcaacaaggcccugagcaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacggcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8880 - RNA, 3495 nt, Artificial Sequence
  derived and/or modified CDS sequence (opt4) from CCHVF(CCHVF K168_125)__KX013460.1__Gn-NSm-Gc
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaaggugccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggccacggcaagaccaucgagaccuaccaggugagagaggaguacaccagcaucugccuguucgugcugggcagcauccuguucaucgugagcugccugaugaagggccuggugaacagcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccguggaggugagcaacaaggcccugagcaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugaagggcaagaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8881 - RNA, 3495 nt, Artificial Sequence
  derived and/or modified CDS sequence (opt4) from CCHVF(CCHVF K229_194)__KX013463.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaagggcaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccagcuucugccaccaggagugccaggugaccgagaccgagugccugugccccuacgaggcccuggugcugagaaagccccuguuccuggacagcaucgugaagggcaagaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacagcugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 8882 - RNA, 3495 nt, Artificial Sequence
  derived and/or modified CDS sequence (opt4) from CCHVF(CCHVF K229_243)__KX013466.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccugacccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8883 - RNA, 3495 nt, Artificial Sequence
  derived and/or modified CDS sequence (opt4) from CCHVF(CCHVF K315_14)__KX013469.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguguacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaagcugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8884 - RNA, 3495 nt, Artificial Sequence
  derived and/or modified CDS sequence (opt4) from CCHVF(CCHVF K323_27)__KX013472.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaccgugcugcuggugcugcugaccgugagccugagccccgugcagagcgcccccgugggccacggcaacaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugcccccacugcagacacagaagcgccgacagagagauccaccagcugcaccugagcaucugcaagaagagaaagaccggcagcaacgugaugcuggccgugugcaagagaaugugccccaaggccaccaucgaggccagcagaagagcccugcccaucagaagcaucaucaacaccacccuggugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccggccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaacgacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8885 - RNA, 3495 nt, Artificial Sequence
  derived and/or modified CDS sequence (opt4) from CCHVF(CCHVF K340_6)__KX013475.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcaccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacauccccccccugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccugagccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggaggugaccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacacuucaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8886 - RNA, 3495 nt, Artificial Sequence
  derived and/or modified CDS sequence (opt4) from CCHVF(CCHVF Mamon)__KX013478.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugagcgacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccguggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaagaccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8887 - RNA, 3495 nt, Artificial Sequence
  derived and/or modified CDS sequence (opt4) from CCHVF(CCHVF Min)__KX013481.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcaccaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8888 - RNA, 3495 nt, Artificial Sequence
  derived and/or modified CDS sequence (opt4) from CCHVF(CCHVF Nakiwogo)__KX013484.1__Gn-NSm-Gc
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcguggugugcaaggugcuguucuaccugcugaucgugaucggcacccugggcaagaagcugaagcaguacagagagcugaagccccagaccugcaucgugugcgagagcauccccgugaacgugaucgacgccgagaugcacgagcugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggccaggagaaggccaucgagguguaccaggugagagagagcuacaccagcaugugccuguucgugcugggcagcgugcuguucgccgugagcuggcuggugaagggccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaucacccacagaaugcaccugaacaucugcaagagaagaaaggugggcagcaacgugaugcuggccgugugcaagagaaugugcuucaaggccaccguggaggccagcaacagcgcccugcugaucagaagcaucaucaacagcaccuucgugaucugcgugcugauccuggugaucugcguggugagcaccagcgccguggacauggagaaccugcccgccggcaucugggagagagaggaggaccugaccaacuucugccaccaggagugccaggugaccgagaccgagugccugugccccuacgaggcccugauccugagaaagccccuguaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacgugcagcagagacugcccagcgagaucgugacccugcaccccaagaucgaggagggcuucuucgaccugaugcacgugcagaaggugcuguucugcaagcacagccugcaggccaccagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucgugaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagcugggcgccgacagcaccuucaaggccuucagcagcaugcccaagaacagccugugcuucuacaucguggagagagacuacugcagcagcugcaccgacgacgacacccagaagugcgugaacaccaagcuggagcacccccagagcauccugaucgagcacaagggcaccaucaucggcaagcagaacgacaccugccccaccaagaccagcugcuggcuggagagcgugaagagcuucuucuacggccugaagaacaugcugggcggcaucuucggcaacguguuccugggcaucuuccuguuccuggcccccuucgcccugcugauccuguucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggc

SEQ ID NO: 8889 - RNA, 3495 nt, Artificial Sequence
  derived and/or modified CDS sequence (opt4) from CCHVF(CCHVF Saf)__KX013487.1__Gn-NSm-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuaccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguuccuggugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagagcccugcugaucagaagcaucaucaacaccaccuucgugaucugcauccugacccugaccaucugcguggugagcaccagcgccguggagauggagaaccugcccagcggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaugaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgugagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8890 - RNA, 3495 nt, Artificial Sequence
  derived and/or modified CDS sequence (opt4) from CCHVF(CCHVF Ast199)__KX056051.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaugcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 8891 - RNA, 3495 nt, Artificial Sequence
  derived and/or modified CDS sequence (opt4) from CCHVF(CCHVF Ast149)__KX056054.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcccaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggcccuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 8892 - RNA, 3495 nt, Artificial Sequence
  derived and/or modified CDS sequence (opt4) from CCHVF(CCHVF Ast137)__KX056057.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccauccacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccaacaucugccuguucaugcugggcagcauccuguucaucgugagcuaccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugggcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugacccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 8893 - RNA, 3495 nt, Artificial Sequence
  derived and/or modified CDS sequence (opt4) from CCHVF(CCHVF Ast133)__KX056060.1__Gn-NSm-Gc
agcgaggagcccgacgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaugugcauccugacccuggccaucugcguggugagcaccagcgccguggagauggaggaccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcagcaagacccacaucggc

SEQ ID NO: 8894 - RNA, 3495 nt, Artificial Sequence
  derived and/or modified CDS sequence (opt4) from CCHVF(CCHVF SK/2015/human)__KX458183.1__Gn-NSm-Gc
agcgaggagagcggcgacgacugcaucagcagaaccagacugcugagaaccgagaccgccgagauccacggcgacagcuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugagaugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaccaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccacggcaagaccaucgagaccuaccaggccagagaggaguacaccggcaucugccuguucgugcugggcagcauccuguucaucgugagcugccuggugaagggccugguggacggcgugggcaacaucuucuuccccggccugagcaucugcaagaccugcagcaucggcagcaucaacggcuucgagaucgagagccacaagugcuacugcagccugcugugcugccccuacugcagacacugcagcgccgacagagagauccaccagcugcaccugagcaucugcaagaagagaaagaccggcagcaacgugaugcuggccgugugcaagagaaugugcuucagagccaccauggaggugagcaacaaggcccugcugaucagaagcaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaagaccccuguuccuggacagcaucgugagaggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcgugagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccagggcagacagugcagccugaucgaggccggcaccagauucaaccugggcagcgugaccaucacccugagcgagcccagaaacauccagcacaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacagaggcaccaucaucggcaagcagaacaacaccugcaucgccaaggccagcugcuggcuggagagcgugaagagcuucuucuacggccugaagaacaugcugagcggcaucuucggcaaccuguuccugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8895 - RNA, 3495 nt, Artificial Sequence
  derived and/or modified CDS sequence (opt4) from CCHVF(CCHVF YL16070)__KY354081.1__Gn-NSm-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugaagagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgugugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaugagccccgugcagagcgcccccgugggcaaggagagagccaucgagaccuaccaggccagagaggccuacaccggcaucugccuguucgugcugggcagcgugcuguucgccgugagcuggcugaccaaggcccugaucgacggcaucggcaacagcuucuuccccggccugagcgugugcaagaccugcagcaucggcagcaucaacggcuucgagaucgagagccacaagugcuacugcagccuguucugcugccccuacugcagagccugcagcagcgacaagaacacccacagaaugcaccugaacgugugcaagaagagaaagaugggcagcaacgugaugcuggccgugugcaagagaaugugcuucagagccaccaucgaggccagcaacaaggcccugcugaucagaagcaucaucaacagcaccuucgugaucugcauccugauccugaccaucugcguggugagcaccagcgccguggacauggagaaccugcccgccggcaucugggagaaggaggaggaccugaccaacuucugccaccaggagugccaggugaccgagaccgagugccugugccccuacgaggccauggugcugagaaagccccuguuccuggacagcaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcugaagagcuucaagggcuucuucuacggccugaagaacaugcugagcggcaucuucggcaacguguuccugggcauccugcuguuccuggcccccuucgugcugcugaucuucuucuucuucuucggcuggagacugcuguucugccugaagugcugcaagaagaccaagggccugcugaaguacaagcaccugaaggacaaggaggaggccggcuacaagaagaucaucgagagacugaacggcaagaagggcaagagccagcuguucgacggcgagagacuggccaacagaaagaucgccgagcuguucagcaccaagauccacaucggc

SEQ ID NO: 8896 - RNA, 3495 nt, Artificial Sequence
  derived and/or modified CDS sequence (opt4) from CCHVF(CCHVF Oman_812956)__KY362518.1__Gn-NSm-Gc
agcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggccacggcaagaccaucgagaccuaccagaccagagagggcuacaccagcaucugccuguucgugcugggcagcauccuguucaucgugagccaccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacaaggagauccacaagcugcaccugagcaucugcaagaagagaaaggccggcagcaacgugaugcuggccgugugcaagagaaugugcuucagagccaccauggaggugagcaacaaggcccugcugaucagaagcgugaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucuucgacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8897 - RNA, 3495 nt, Artificial Sequence
  derived and/or modified CDS sequence (opt4) from CCHVF(CCHVF UCCR4405)__KY484029.1__Gn-NSm-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggccacggcaagaccaucgagaccuaccagaccagagagggcuucaccagcaucugccuguucaugcugggcagcauccuguucaucgugagcugccuggugaagggccugguggacagcgugagcgacagcuucuuccccggccugagcgugugcaagaccugcagcaucggcagcaucaacggcuucgagaucgagagccacaagugcuacugcagccuguucugcugccccuacugcagacacuacagcgccgacagagagauccaccagcugcaccugagcaucugcaagaagagaaagaccggcagcaacgugaugcuggccgugugcaagagaaugugcuucaaggccaccaucgaggccagcagaagagcccugcugaucagaagcaucaucaacaccaccuucgugaucugcauccugauccuggccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8898 - RNA, 3495 nt, Artificial Sequence
  derived and/or modified CDS sequence (opt4) from CCHVF(CCHVF UCCR4459)__KY484032.1__Gn-NSm-Gc
agcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggccacggcaagaccguggagaccuaccagaccagagagggcuacaccagcaucugccuguucgugcugggcagcauccuguucaucgugagcugccugaugaagggccugguggacagcgugggcaacagcuucuuccccggccugagcaucugcaagaccugcagcaucggcagcaucaacggcuucgagaucgagagccacaagugcuacugcagccuguucugcugccccuacugcagacacugcagcgccgacagagagauccacaagcugcaccugagcaucugcaagaagagaaagaccggcagcaacgugaugcuggccgugugcaagagaaugugcuucagagccaccguggaggugagcaacaaggcccugcugaucagaaacaucaucaacaccaccuucguggugugcauccugauccuggccgugugcguggugagcaccagcgccguggagauggagagccugcccgccggcaccugggagagagaggaggaccugaccaacuucugccaccaggagugccaggugaccgagaccgagugccugugccccuacgaggcccuggugcugagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8899 - RNA, 3495 nt, Artificial Sequence
  derived and/or modified CDS sequence (opt4) from CCHVF(CCHVF UCCR4401)__KY484035.1__Gn-NSm-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggc

SEQ ID NO: 8900 - RNA, 3495 nt, Artificial Sequence
  derived and/or modified CDS sequence (opt4) from CCHVF(CCHVF UCCR4448)__KY484042.1__Gn-NSm-Gc
agcgaggagaccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccaucagccugagccccgugcagagcgcccccaucagccacggcaagaccaucgaggccuacagagccagagagggcuacaccagcaucugccuguucgugcugggcagcauccuguucaucgugagcuaccugaugaagggccugguggacagcgugggcaacagcuucuuccccggccugagcaucugcaagaccugcagcaccagcagcaucaacggcuucgagaucgagagccacaagugcuacugcagccuguucugcugccccuacugcagacacugcagcgccgacaaggagauccacaagcugcaccugagcaucugcaagaagagaaagaccggcagcaacgugaugcuggccgugugcaagagaaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagaagaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagauccuggccgacagaagaaucgccgagcuguucagcaccaagacccacaucggc

SEQ ID NO: 8901 - RNA, 3495 nt, Artificial Sequence; identical to SEQ ID NO: 8817
  derived and/or modified CDS sequence (opt4) from CCHVF(CCHVF SPU4/81 )__DQ157175.1__Gn-NSm-Gc

SEQ ID NO: 8902 - RNA, 3495 nt, Artificial Sequence; identical to SEQ ID NO: 8838
  derived and/or modified CDS sequence (opt4) from CCHVF(CCHVF Sudan Al-Fulah 9-2008)__HQ378185.1__Gn-NSm-Gc

SEQ ID NO: 8903 - RNA, 3495 nt, Artificial Sequence; identical to SEQ ID NO: 8832
  derived and/or modified CDS sequence (opt4) from CCHVF(CCHVF NIV161064)__KY213713.1__Gn-NSm-Gc

SEQ ID NO: 8904 - RNA, 3495 nt, Artificial Sequence; identical to SEQ ID NO: 8854
  derived and/or modified CDS sequence (opt4) from CCHVF(CCHVF 5180-R-2011)__KR814874.1__Gn-NSm-Gc

SEQ ID NO: 8905 - RNA, 3495 nt, Artificial Sequence; identical to SEQ ID NO: 8862
  derived and/or modified CDS sequence (opt4) from CCHVF(CCHVF 4574-ST-2008)__KR814870.1__Gn-NSm-Gc

SEQ ID NO: 8906 - RNA, 3495 nt, Artificial Sequence; identical to SEQ ID NO: 8814
  derived and/or modified CDS sequence (opt4) from CCHVF(CCHVF 3010)__DQ019222.1__Gn-NSm-Gc

SEQ ID NO: 8907 - RNA, 3495 nt, Artificial Sequence; identical to SEQ ID NO: 8814
  derived and/or modified CDS sequence (opt4) from CCHVF(CCHVF UG3010)__DQ211637.1__Gn-NSm-Gc

SEQ ID NO: 8908 - RNA, 2916 nt, Artificial Sequence
  derived and/or modified CDS sequence (opt4) from CCHFV(10200, Artificial)__U39455.2__Gn-4aa-Gc
agcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggc

SEQ ID NO: 8909 - RNA, 2916 nt, Artificial Sequence
  derived and/or modified CDS sequence (opt4) from CCHFV(IbAr10200, Artificial)__AF467768.2__Gn-4aa-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacaggugggcgaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggc

SEQ ID NO: 8910 - RNA, 2916 nt, Artificial Sequence
  derived and/or modified CDS sequence (opt4) from CCHFV(Turkey-Kelkit06, Artificial)__GQ337054.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggugcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggagccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggcccugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcggcaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggc

SEQ ID NO: 8911 - RNA, 2919 nt, Artificial Sequence
  derived and/or modified CDS sequence (opt4) from CCHFV(SR3, Artificial)__AJ538199.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggccugagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcaacaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8912 - RNA, 2919 nt, Artificial Sequence
  derived and/or modified CDS sequence (opt4) from CCHFV(UCCR4413, Artificial)__KY484038.1__Gn-4aa-Gc
agcgagagcagcgccagcggcugcaucagcagaacccagaugaucaagagcgagaccgccgagauccacgacgacaucuacggcggccccggcgagaagcugaccaucugcaacggcaccaccgugguggaccagagacugggcagcgagcugggcugcuacaccaucaacagaaucaagaccuacaagcugugcgagaacagcgugaaggagaagaccugcgagaucgacagcgugcccgugaagugcagacagggccugugccugaagaucacccaggagggcagaggccacgugaagcugagcagaggcagcgagaucgugcuggacaucugcgacagcagcugcgagcugaugauccccaagggcaccggcgacauccugguggacugcagcggcggccagcagcacuuccugcaggacaaccugguggaccugggcugccccaacaucccccugcugggcaagguggccaucuacaucugcagaaugagcaaccaccccaagaccaccauggccuuccuguucugguucagcuucggcuacgugaucaccugcauccugugcaagauccuguucuaccugcugaucaucaccggcacccugggcaagaagcugaagcaguacagagagcugaagccccagaccugcaccaucugcgagagcacccccgugaacgccaucgacgccgagaugcacgaccugaacugcagcuacaacaucugccccuacugcgccagcagacugaccagcgacggccugaucagacacgugaaccugugccccaagagaaaggagaagguggaggagaccgagcuguaccugaaccuggagagaauccccugguucgugagaaagcugcugcaggugagcgagagcaccggcguggcccugaagagaagcagcuggcugcugauccuggugauccugcugaccgugagcaugagccccgugcagagcgcccccaucaacagaaagccccuguuccugagcagcaucgugaagggcaagaagaaccugcugaacagcgccagccuggagaccagccugagcaucgaggcccccuggggcgccaucaacgcccagagcaccuucaagcccaccaucagcaccgccaacaucgcccugagcuggagcagcguggagcacagaggcaacaaggugcuggugagcggcagaagcgagagcaucaugaagcuggaggagagaaccggcaucagcuggaaccugggcguggaggacgccagcgagagcagaaugcugaccgugagcgugauggaccugagccagauguaccugcccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugcccagcgagaucgugacccugcaccccaagaucgaggagggcuucuucgaccugaugcacgugcagaaggugcugagcgccagcaccgugugcaagcugcagagcugcacccacggcguggccggcgaccugcagguguaccacgugggcaaccugcugaagggcgacaagaucaacggccacagcauccacaagaucgagccccaccugaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagagcuuccacuuccacagcaagagagugaccgcccacggcgacaccccccagcuggaccugaaggccagacccauguacggcgccggcgagaucaccgugcugguggagguggccgacauggagcugcacagcaagaacaucgagaucagcggccugaaguucgccagccugaccugcagcggcugcuacgccugcagcagcggcaucagcugcaaggugagaauccacguggacgagcccgacgagcuggccgugcacgugaagagcgacgaccuggacgugguggccgccagcagcagccugauggccagaaagaucgaguucggcaccgacagcaccuucaaggccuucagcagcaugcccaaggagagccugugcuucuacaucguggagagagacuucugcaagagcugcgccgccgaggacacccagaagugcgugaaggccaagcuggagcagccccagagcauccugaucgagcacaagggcaccaucaucggcaagcagaacgacaccugcagcaccaagaccagcugcuggcuggagagcuucaagagcuucuucuacggccugaagaacaugcugagcggcguguucggcagcgccaucaugggcauccugcuguuccuggcccccuucauccugcugauccuguucuucuucuucggcuggagaauccuguucugccugagaugcugcagaagaaccagaggccuguucaaguacaagcacaucaaggacgacgaggaggccggcuacaagaagaucaucgagaagcugaacaacaagaagggcggcaccagcaagcugcuggacggcgagagacuggccgacagaaagaucgccgagcuguucagcaccaaggcccacaucggc

SEQ ID NO: 8913 - RNA, 2916 nt, Artificial Sequence
  derived and/or modified CDS sequence (opt4) from CCHFV(66019, Artificial)__AB069669.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaacacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcaacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 8914 - RNA, 2916 nt, Artificial Sequence
  derived and/or modified CDS sequence (opt4) from CCHFV(7001, Artificial)__AB069670.1__Gn-4aa-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcagaaagccccuguuccuggacaacaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 8915 - RNA, 2916 nt, Artificial Sequence
  derived and/or modified CDS sequence (opt4) from CCHFV(75024, Artificial)__AB069671.1__Gn-4aa-Gc
agcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucggcagaagaccccuguuccuggacagcaucgugagaggcaugaagaaccagcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaaccuguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8916 - RNA, 2916 nt, Artificial Sequence
  derived and/or modified CDS sequence (opt4) from CCHFV(7803, Artificial)__AB069672.1__Gn-4aa-Gc
agcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgaggugauccuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucagcagaagaccccuguuccuggacagcaucgugagaggcaugaagaacccccugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccagaggcaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8917 - RNA, 2916 nt, Artificial Sequence
  derived and/or modified CDS sequence (opt4) from CCHFV(79121, Artificial)__AB069673.1__Gn-4aa-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagggccugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcagaaagccccuguuccuggacagcaccgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagaucuaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaaccuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 8918 - RNA, 2916 nt, Artificial Sequence
  derived and/or modified CDS sequence (opt4) from CCHFV(8402, Artificial)__AB069674.1__Gn-4aa-Gc
agcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8919 - RNA, 2916 nt, Artificial Sequence
  derived and/or modified CDS sequence (opt4) from CCHFV(88166, Artificial)__AB069675.1__Gn-4aa-Gc
agcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggcagaaagccccuguucagcgacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgaccugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8920 - RNA, 2916 nt, Artificial Sequence
  derived and/or modified CDS sequence (opt4) from CCHFV(BA88166, Artificial)__AF338470.1__Gn-4aa-Gc
agcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaagggcaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggcagaaagccccuguaccuggacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaucaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8921 - RNA, 2916 nt, Artificial Sequence
  derived and/or modified CDS sequence (opt4) from CCHFV(BA66019, Artificial)__AF350448.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaagcaccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 8922 - RNA, 2916 nt, Artificial Sequence
  derived and/or modified CDS sequence (opt4) from CCHFV(BA8402, Artificial)__AF350449.1__Gn-4aa-Gc
agcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaacagcuucaaccugugcgagaacaccgccaccggcaagagcugcgagaucgacagcacccccgugaagugcagacagggcuucugccugaagaucacccaggagggcagaggccacgugaagcugagcagaggcagcgagguggugcuggacgccugcgagagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacccaccagcgacggccuggccagacacgugaugcagugccccaagagaaaggagaagaucgaggagaccgcccuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccugcacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8923 - RNA, 2916 nt, Artificial Sequence
  derived and/or modified CDS sequence (opt4) from CCHFV(Matin, Artificial)__AF467769.2__Gn-4aa-Gc
agcgaggagagcggcgacgacugcaucagcagaacccagcugcugagaaccgagaccgccgagauccacagcgacagcuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggcagaaagccccuguuccuggacagcaucaucaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggugaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugagcaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucgcccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacgugggc

SEQ ID NO: 8924 - RNA, 2916 nt, Artificial Sequence
  derived and/or modified CDS sequence (opt4) from CCHFV(Baghdad 12, Artificial)__AJ538197.2__Gn-4aa-Gc
agcgaggagagcggcgacgacugcaucagcagaaccagacugcugagaaccgagaccgccgagauccacggcgacagcuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcaagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcuggccgugagcagcagccccgugcagagcgcccccaucggcagaaagccccuguuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgacgccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggugagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8925 - RNA, 2916 nt, Artificial Sequence
  derived and/or modified CDS sequence (opt4) from CCHFV(VLG/TI29414, Artificial)__AY179961.1__Gn-4aa-Gc
agcgaggagcccggcgacgacugcaucagcagaacccagcugcugagagccgagcccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaacgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcugggaggugggcaccggcugcaccugcugcggcuggaacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcaugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugaucgccgccagcaccagccugauggccagaaagcuggaguucggcaccgacagcaccuucaaggccuucagcgccaugcccaagaccagccugugcuucuacaucgccgagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8926 - RNA, 2916 nt, Artificial Sequence
  derived and/or modified CDS sequence (opt4) from CCHFV(TADJ/HU8966, Artificial)__AY179962.1__Gn-4aa-Gc
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugaagaucacccaggagggcagaggccacgugaagcugagcagaggcagcgagguggugcuggacgccugcgacagcagcugcgaggugaugauccccaagggcaccggcgacaucagcguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccagaauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagagaguggaggagaccgagcuguaccugaaccuggagagaauccccuggaucgugagaaagcugcugcaggugagcgagagcaccggcguggcccugaagagaagcagcuggcugaucgugcugcuggugcuguucaccgugagccugagccccgugcagagcgcccccaucggcagaagaccccuguuccuggacagcaucgugaagggcaugaagaacccccugaacagcaccagccuggagaccagccugagcaucgaggcccccuggggcgccaucaacgugcagagcaccuacaagcccaccgugagcaccgccaacaucgcccugagcuggagcagcaucgagcacagaggcaacaacauccuggugagcggcagaagcgagagcaucaugaagcuggaggagagaaccggcaucagcggcgaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaucgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggagaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacagaaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccugagcugcuucaagugcugcagaagaaccagaggccugcugaagcacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8927 - RNA, 2916 nt, Artificial Sequence
  derived and/or modified CDS sequence (opt4) from CCHFV(Hodzha, Artificial)__AY223476.1__Gn-4aa-Gc
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcaagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggcagaagaccccuguuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagagaaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8928 - RNA, 2916 nt, Artificial Sequence
  derived and/or modified CDS sequence (opt4) from CCHFV(Kosovo/9553/2001, Artificial)__AY675511.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucgccagaaugagcaaccaccccaagaccaccauggccuuccuguucugguucagccugggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcccaacgacaccugccccgccaagaccagcugcuggcuggagagcgugaagagcuucuucuacggccugaagaacaugcugggcagcguguucggcaacuucuucaucggcauccugcuguuccuggcccccuucuuccuguggaugcugagcuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8929 - RNA, 2916 nt, Artificial Sequence
  derived and/or modified CDS sequence (opt4) from CCHFV(SPU41/84, Artificial)__AY900142.1__Gn-4aa-Gc
agcgaggagagcagcgacgacugcaucagcagaacccagcugcugagaaccgagaccgccgagauccacggcgacaacuacggcggccccggcgacaagaucaccaucugcaacggcagcaccgugguggaccagagacugggcagcgagcugggcugcuacaccaucaacagagugaagaccuucaagcugugcgagaacagcgccaccggcaagagcugcgagaucgacagcgugcccgugaagugcagacagggcuacugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucaucugcaaggugaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccuggugcacaagaucgagccccacuucaacaccagcuggaugagcugggacggcugcgaccuggacuacuacugcaacaugggcgacuggcccagcugcaccuacaccggcgugacccagcacaaccacgccagcuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucaccagccugaccugcaccggcugcuacgccugcagcagcggcaucagcugcaaggugagaauccacguggacgagcccgacgagcugaccgugcacgugaagagcgaggaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagagaaagggcaccaucaucggcaagcagaacaacaccugcaaggccaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaagaaucgccgagcuguucagcaccaagacccacaucggc

SEQ ID NO: 8930 - RNA, 2916 nt, Artificial Sequence
  derived and/or modified CDS sequence (opt4) from CCHFV(UG3010, Artificial)__AY900143.1__Gn-4aa-Gc
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcaucgugugcaaggugcuguucuaccugcugaucgugaucggcacccugagcaagaagcugaagcaguacagagagcugaagccccagaccugcaucgugugcgagagcacccccgugaacgccaucgacgccgagaugcacgagcugaacugcaacuacaacaucugccccuacugcgccagcagacugaccagcgacggccuggugagacacgugaaccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggcagaaagccccuguaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccaggagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacauccagcagagacugcccagcgagaucgugacccugcaccccaagaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcagcgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccaacgacgacacccagaagugcguggacaccaagcuggagcacccccagagcauccugaucgagcacaagggcaccaucaucggcaagcagaacgacaccugcagcaccaagaccagcugcuggcuggagagcgugaagagcuucuucuacggccugaagaacaugcugggcggcaucuucggcaacguguuccugggcaucuuccuguuccuggcccccuucgcccugcugaucuucuucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggc

SEQ ID NO: 8931 - RNA, 2916 nt, Artificial Sequence
  derived and/or modified CDS sequence (opt4) from CCHFV(Hy13, Artificial)__AY900145.1__Gn-4aa-Gc
agcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8932 - RNA, 2916 nt, Artificial Sequence
  derived and/or modified CDS sequence (opt4) from CCHFV(Semunya, Artificial)__DQ094832.1__Gn-4aa-Gc
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcguggugugcaaggugcuguucuaccugcugaucgugaucggcacccugggcaagaagcugaagcaguacagagagcugaagccccagaccugcaucgugugcgagagcauccccgugaacgccaucgacgccgagaugcacgagcugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggcagaaagccccuguuccuggacagcaucgccaagggcaagaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacgugcagcagagacugcccagcgagaucgugacccugcaccccaagaucgaggagggcuucuucgaccugaugcacgugcagaaggugcuguucugcaaguacagccugcaggccaccagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucgugaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccgacgacgacacccagaagugcgugaacaucaagcuggagcacccccagagcauccugaucgagcacaagggcaccaucaucggcaagcagaacgacaccugccccaccaagaccagcugcuggcuggagagcgugaagagcuucuucuacggccugaagaacaugcugggcggcaucuucggcaacguguuccugggcaucuuccuguuccuggcccccuucgcccugcugauccuguucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccaagcuguucagcaccaagacccacaucggc

SEQ ID NO: 8933 - RNA, 2916 nt, Artificial Sequence
  derived and/or modified CDS sequence (opt4) from CCHFV(SPU128/81/7, Artificial)__DQ157174.1__Gn-4aa-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgagagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaaagccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaucggcaucuuccuguuccugggccccuucauccugcugauccuguucuucauguucggcuggagaauccuguucugcuucaagugcugcagaagaaccagaggccugcugaaguacagacaccugaaggaggacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8934 - RNA, 2916 nt, Artificial Sequence
  derived and/or modified CDS sequence (opt4) from CCHFV(ROS/HUVLV-100, Artificial)__DQ206448.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8935 - RNA, 2916 nt, Artificial Sequence
  derived and/or modified CDS sequence (opt4) from CCHFV(AP92, Artificial)__DQ211625.1__Gn-4aa-Gc
agcgagggcggcgacggcggcugcaucagcagaacccagcugaucaagaccgagaccgccgaggugcacggcgacgacuacggcggccccggcgagaagaucaccaucugcaacggcagcaccaucguggaccagagacugggcagcgagcugggcugcuacaccaucaacagaaucaagagcuucaagcugugcgagaacagcgcccagggcaagaacugcgagaucgacagcgcccccgugcagugcagacagggcuacugccugaagaucagccaggagggcagaggccacgugaagcugagcagaggcagcgagaucgugcuggacgugugcgacaccagcugcgagaucaugauccccaagggcaccggcgacauccugguggacugcagcggcggccagcagcacuuccugcagagcaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaagacccuguucuacauccugaucaucaucggcacccugggcaagaagcugaagcaguacagagagcugaagccccagaccugcaccaucugcgagagcgugcccgugaacgccaucgacgccgagaugcacgaccugaacugcagcuacaacaucugccccuacugcgccagcagacugaccagcgagggccugaccagacacgugaaccagugccccaagagaaaggagaagguggaggagaccgagcuguaccugaaccuggagagaauccccuggaucgugagaaagcugcugcaggugagcgagagcaccggcguggcccugaagagaagcagcuggaugaucgugcugcugauccugcugaucgugagcaugagccccgugcagagcgcccccaucagcagaaagccccuguuccuggacagcaucgccaagggcgugaagaaccugcugaacagcaccagccuggagaccagccugagcaucgaggcccccuggggcgccaucaacgcccagagcaccuacaagcccaccgccagcagcgccaacaucgcccugaccuggagcagcguggagcacagaggcaacaagauccuggugagcggcagaagcgagagcaucaugaagcuggaggagagaaccggcaucagcuggaaccugggcguggaggacgccagcgagagcagaacccugaccaucagcgugauggaccugagccagauguacagccccguguucgaguaccugagcggcgacagacagguggaggaguggcccaaggccaccugcaccggcaacugccccgagagaugcggcugcaccagcagcaccugccuguacaaggaguggccccacagcagaaacuggagaugcaaccccaccuggugcuggggcgugggcaccggcugcaccugcugcggccuggacgugaaggagcuguucaccgaccacaugcuggugaaguggaagguggaguacaucaagaccgaggccaucgugugcguggagcugaccagccaggagagacagugcagccugaucgaggccggcaccagauucagccugggccccgugaccaucacccugagcgagcccagaaacauccagcagaagcugccccccgagcugaucacccugcaccccaagaucgaggacggcuacuucgaccugaugcacgugcagaaggugaugagcgccagcaccgugugcaagcugcagagcugcacccacggcgugcccggcgaccugcagaucuaccacgugggcaaccugcugaagggcgacagagugaacggccaccugauccacaagguggagccccaccugaacaccagcuggaugagcugggacggcugcgaccuggacuacuucugcaacaugggcgacuggcccagcugcaccuacaccggcgugacccagcacaaccacgccgccuucgccaaccugcugaacaucgagaccgacuacaccaagaccuuccacuuccacagcaagagagugaccgcccacggcgacaccccccagcuggaccugaaggccagacccagauacggcgccggcgagaucaccgugcugguggagguggccgacauggagcugcacaccaagaagguggaggugaccggccugaaguucgccagccugaccugcagcggcugcuacgccugcagcagcggcaucagcugcaaggugagaauccacguggacgagcccgacgagcugaccgugcacgugaagagcagcgaccccgacaucguggccgccagcagcagccugauggccagaaagaucgaguucggcguggacagcaccuucaaggccuucagcagcaugcccaaggacagccugugcuucuacaucguggagagagacuacugcaacagcugcaagaacgaggagacccagagaugcgugaacgccaagcuggagcagccccagagcauccugaucgagcacaccggcaccaucaucggcaagcagaacgacaccugcggcagcagaaccagcugcuggcuggacagcuucaagagcuucuucuacggccugaagagcaugcugagcggcaucuucggcaacguguuccugggcaucuuccuguuccuggcccccuucgcccugcugcuguucuucuucuucuucggcuggagaauccuguucugcuucaagugcugcagaagaaccagaggccuguucaaguacagacacaucaaggacgacgaggaggugggcuacaagaagaucaucgagagacugaacaacaagaagggcaagcacagacugcuggacggcgagagacuggccgacagaaagaucgccgagcuguucagcaccaagacccacaucggc

SEQ ID NO: 8936 - RNA, 2916 nt, Artificial Sequence
  derived and/or modified CDS sequence (opt4) from CCHFV(ArD8194, Artificial)__DQ211626.1__Gn-4aa-Gc
gccgagggcggcagcaacgacugcgugagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugagaaccuacaagcugugcgagaacagcgccaccgagaagagcugcgagaucgacagcgugcccgugaagugcaagcagggcuucugccugaagaucacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacaucccccugcugggcagaaccgccaucuacgugugcagaaugagcaaccaccccaagaccaccauggccuuccuguucugguucagcuucggcuacgugaucaccugcguggugugcaaggugcuguucuaccugcugaucgugaucggcacccugggcaagagacugaagcaguacagagagcugaagccccagaccugcaucgugugcgagagcauccccgugaacgccaucgacgccgagaugcacgaccugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaaagcugcugcaggugagcgagagcaccggcguggcccugaagagaagcugcuggaugaucacccugcugauccugcugaccgugagcaugagccccgugcagagcgcccccgugggcagaaagccccuguuccuggacagaaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacaagggcaacaagauccuggugagcggcagaagcgagagcaucaugaagcuggaggagagaaccggcaucagcuggugccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacaugcuggugaaguggaagguggaguacaucaagaccgaggccaucaucugcguggagcugaccagccaggagagacagugcagccugaucgaggccggcaccagauucaaccugggccccgugaccaucacccugagcgagcccagaaacgugcagcagagacugccccccgagaucaucacccugcaccccaagaucgaggagggcuucuucgaccugaugcacgugcagaaggugaugagcgccagcaccgugugcaagcugcagagcugcacccacggcgugcccggcgaccugcagguguaccacgugggcaaccugcugaagggcgacaaggugaacggccacagcauccacaagaucgagagccaccugaacaccagcuggaugagcugggacggcugcgaccuggacuacuucugcaacaugggcgacuggcccagcugcaccuacaccggcgugacccagcacaaccacgccgccuucaucaacaugcugaacaucgagaccgacuacaccaagaccuuccacuuccacagcaagagagugaccgcccacggcgacaccccccagcuggaccugaaggccagacccgccuacggcgccggcgagaucaccgugcugguggagguggccgaccuggagcugcacaccaagaagaucgaggugagcggccugaaguucgccagccugagcugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagagcggcgccgacagcaccuucaaggccuucagcagcaugcccaagaacagccugugcuucuacaucguggagagagacuacugcagcagcugcaccgacgacgacacccagaagugcguggacaucaagcuggagcacccccagagcauccugaucgagcacaagggcaccaucaucggcaagcagaacgacaccugccccaccaagaccagcugcuggcuggagagcaucaagagcuucuucuacggccugaagaacaugcugagcggcaucuucggcaacguguuccugggcaugcugcuguuccuggcccccuucauccugcugauccuguucuucuucuucggcuggagacugcuguucugccugaagugcugcagaagaaccagaaagcugcugaaguacaagcaccugagagacgaggaggagagcggcuacaagaagaucaucgagagacugaacgacaagaagggcaagagcagacuguucgacggcgagagacuggccgacagaaagaucgccgagcuguucagcaccaagacccacaucggc

SEQ ID NO: 8937 - RNA, 2916 nt, Artificial Sequence
  derived and/or modified CDS sequence (opt4) from CCHFV(ArD15786, Artificial)__DQ211627.1__Gn-4aa-Gc
gccgagggcggcagcaacgacugcgugagcagaacccagcuggugaagaccgaggugaccgagauccacgaggacagcuacggcggccccggcgagaagaucaccaucugcaacggcagcaccaucguggaccagagacugggcagcgagcugggcugcuacaccaucaacagagugagaaccuacaagcugugcgagaacagcgccaccgagaagagcugcgagaucgacagcgugcccgugaagugcaagcagggcuucugccugaagaucacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacaucccccugcugggccagaccgccaucuacgugugcagaaugagcaaccaccccaagaccaccauggccuuccuguucugguucagcuucggcuacgugaucaccugcguggugugcaaggugcuguucuaccugcugaucgugaucggcacccugggcaagagacugaagcaguacagagagcugaagccccagaccugcaucgugugcgagagcauccccgugaacgccaucgacgccgagaugcacgaccugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaaagcugcugcaggugagcgagagcaccggcguggcccugaagagaagcugcuggaucaucacccugcugauccugcugaccgugagcaugagccccgugcagagcgcccccgugggcagaaagccccugagccuggacagcaucgccaagggcaugaagagccugcugaacagcaccagccuggagaccagccugagcaucgaggcccccuggggcgccaucaacgugcagagcaccuucaagcccaccaucagcgccgccaacaucgcccugagcuggagcagcguggagcacaagggcaacaagauccuggugagcggcagaagcgagagcaucaugaagcuggaggagagaaccggcaucagcuggugccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacaugcuggugaaguggaagguggaguacaucaagaccgaggccaucaucugcguggagcugaccagccaggagagacagugcagccugaucgaggccggcaccagauucaaccugggccccgugaccaucacccugagcgagcccagaaacgugcagcagagacugccccccgagaucaucacccugcaccccaagaucgaggagggcuucuucgaccugaugcacgugcagaaggugaugagcgccagcaccgugugcaagcugcagagcugcacccacggcgugcccggcgaccugcagguguaccacgugggcaaccugcugaagggcgacaaggugaacggccacagcauccacaagaucgagagccaccugaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagagcggcgccgacagcaccuucaaggccuucagcagcaugcccaagaacagccugugcuucuacaucguggagagagacuacugcagcagcugcaccgacgacgacacccagaagugcguggacaucaagcuggagcacccccagagcauccugaucgagcacaagggcaccaucaucggcaagcagaacgacaccugccccaccaagaccagcugcuggcuggagagcaucaagagcuucuucuacggccugaagaacaugcugagcggcaucuucggcaacaucuuccugggcaugcugcuguuccuggcccccuucgugcugcugauccuguucuucuucuucggcuggagacugcuguucugccugaagugcugcagaagaaccagaaagcugcugaaguacaagcaccugagagacgaggaggagagcggcuacaagaagaucaucgagagacugaacgacaagaagggcaagagcagacuguucgacggcgagagacuggccgacagaaagaucgccgagcuguucagcaccaagacccacgugggc

SEQ ID NO: 8938 - RNA, 2916 nt, Artificial Sequence
  derived and/or modified CDS sequence (opt4) from CCHFV(ArD39554, Artificial)__DQ211628.1__Gn-4aa-Gc
agcgagagcaacaacaacgacugcgugagcagaacccagcugaucaagaccgagaacgccgagauccacggcgacgacuacggcggccccggcgagaagaucaccaucugcaacggcagcaccaucguggagcagagacugggcagcgagcugggcugcuacaccaucaacagaaucaagagcuucaagcugugcgagaacagcgccagcggcaagggcugcgagaucgacagcacccccgugaagugcaagcagggcuucugccugaagaucacccaggagggcagaggccacgugaagcugagcagaggcagcgagaucauccuggacgugugcgacagcagcugcgagaugaugauccccaagggcagcggcgacauccugguggacugcagcggcggccagcagcacuuccugcaggacaaccugguggaccugggcugccccaacgugccccugcugggcaagauggccaucuacaucugcagaaugagcaaccaccccaagaccaccauggccuuccuguucugguucagcuucggcuacgugaucaccugcaucuucugcaaggugaucuucuacgugcugaucaucaucggcacccugggcaagagaaucaagcaguacagagagcugaagccccagaccugcaccaucugcgaggccacccccgugaacgccaucgacgccgagaugcacgaccugaacugcagcuacaacaucugccccuacugcgccagcagacugaccagcgagggccuggugagacacgugacccagugccccaagagaaaggagaagaucgaggagaccgagcuguaccugaaccuggagagaauccccugguucgugagaaagcugcugcaggugagcgagagcaccggcguggcccugaagagaagcagcuggcuggugacccugcuggugcugcugaccgugagccugagccccgugcagagcgcccccaucggcagaaagccccuguuccuggacagcaccgccaagagcaugaagagccugcugaacagcaccagccuggagaccagccugagcaucgaggcccccuggggcgccaucaacgugcagagcaccuucaagcccaccgccagcaccgccaacaucgcccugagcuggagcagcguggagcacagaggcaacaagauccuggugaccggcagaagcgagagcaucaugaagcuggaggagagaaccggcaucagcuggaaccugggcguggaggacgccagcgagagcaagacccugaccgugagcgugauggaccugagccagauguacagcaccguguucgaguaccugagcggcgacagacagguggaggaguggcccaaggccaccugcaccggcgacugccccgagagaugcggcugcaccagcagcaccugccugcacaaggccuggccccacagcagaaacuggagaugcaaccccaccuggugcuggggcgugggcaccggcugcaccugcugcggccuggacgugaagaaccuguucaccgacuacaugcugaucaaguggaagguggaguucaucaagaccgaggccaucgugugcguggagcugaccagccaggagagacagugcagccugaucgaggccggcaccagauucaaccugggccccgugaccaucacccugagcgagcccagaaacauccagcagaagcugccccccgagcuggugacccugcaccccagaguggaggagggcuucuucgaccugaugcacgugcagaaggugcugagcgccagcaccgugugcaagcugcagagcugcacccacggcgugcccggcgaccugcagguguaccacgugggcaaccugcugaagggcgacaagaucaacggcaacagcuuccacaagaucgagcccaaccugaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgagaccccccagcuggaccugaaggccagacccaaguacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagacugcacguggacgagcccgacgagcugaccgugcacgugaagagcgacgaccccgacgugguggccgccagcagcagccugauggccagaaagaucgaguucggcaccgacagcaccuucaaggccuucagcagcaugcccaaggacaagcugugcuucuacaucguggagagagacuacugcagcagcugcagcaaggaggacacccagaagugcgugaacgccaagcuggagcagccccagagcauccugaucgagcacaagggcaccaucaucggcaagcagaacgacaccugcaccgugaaggccagcugcuggcuggagagcgugaagagcuucuucuacggccugaagaacaugcugggcggcaucuucggcaacgugauccugggcaucaucauguuccuggcccccuucgcccugcugcugcuguucuuccuguucggcuggagaauccuguucugccugagaugcugcagaagaaccagaggccuguucaaguacaagcacaucaaggacgacgaggagagcggcuacaagagaaucaucgagagacugaacaacaagaagggcaagaacaagcuguucgacggcgagagacuggccgacaagaagaucgccgagcuguucagcaccaagacccacaucggc

SEQ ID NO: 8939 - RNA, 2916 nt, Artificial Sequence
  derived and/or modified CDS sequence (opt4) from CCHFV(C-68031, Artificial)__DQ211629.1__Gn-4aa-Gc
agcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8940 - RNA, 2916 nt, Artificial Sequence
  derived and/or modified CDS sequence (opt4) from CCHFV(Drosdov, Artificial)__DQ211630.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaugaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8941 - RNA, 2916 nt, Artificial Sequence
  derived and/or modified CDS sequence (opt4) from CCHFV(Kashmanov, Artificial)__DQ211631.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaacagccugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8942 - RNA, 2916 nt, Artificial Sequence
  derived and/or modified CDS sequence (opt4) from CCHFV(Oman, Artificial)__DQ211632.1__Gn-4aa-Gc
agcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggcagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8943 - RNA, 2916 nt, Artificial Sequence
  derived and/or modified CDS sequence (opt4) from CCHFV(SPU97/85, Artificial)__DQ211633.1__Gn-4aa-Gc
agcgaggagagcgacggcgacugcaucagcagaacccagcugcugagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcagcugcgagaucaugauccccaagggcaccggcgacauccugguggacugcagcggcggccagcagcacuuccugaaggacaaccugaucgaccugggcugccccaacaucccccugcugggcagaauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggcagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacacccagaagugcgugaacaccaagcuggagagaccccagagcauccugaucgagcacaagggcaccaucaucggcaagcagaacgacaccugcaccgccaaggccagcugcuggcuggagagcgugaagagcuucuucuacggccugaagagcaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 8944 - RNA, 2916 nt, Artificial Sequence
  derived and/or modified CDS sequence (opt4) from CCHFV(SPU103/87, Artificial)__DQ211634.1__Gn-4aa-Gc
agcgaggagagcagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagaccuucaagcugugcgagaacagcgccaccggcaagagcugcgagaucgacagcgugcccgugaagugcagacagggcuacugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcgugcugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaagacugcugcaggugagcgagagcaccggcguggcccugaagagaagcagcuggcugaucgugcugcuggugcuguucaccgugagccugagccccgugcagagcgcccccaucagcagaagaccccuguuccuggacaacaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagaucgaguacaucaagaccgaggccaucgugugcguggagcugaccagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccuggugcacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucaccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagcacaagggcaccaucaucggcaagcagaacaacaccugcaaggccagagccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaagaaucgccgagcuguucagcaccaagacccacaucggc

SEQ ID NO: 8945 - RNA, 2916 nt, Artificial Sequence
  derived and/or modified CDS sequence (opt4) from CCHFV(SPU415/85, Artificial)__DQ211635.1__Gn-4aa-Gc
agcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 8946 - RNA, 2916 nt, Artificial Sequence
  derived and/or modified CDS sequence (opt4) from CCHFV(Turkey200310849, Artificial)__DQ211636.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucagcugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccgccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggc

SEQ ID NO: 8947 - RNA, 2916 nt, Artificial Sequence
  derived and/or modified CDS sequence (opt4) from CCHFV(Iran-52, Artificial)__DQ446215.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggaggagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8948 - RNA, 2916 nt, Artificial Sequence
  derived and/or modified CDS sequence (opt4) from CCHFV(Iran-53, Artificial)__DQ446216.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8949 - RNA, 2916 nt, Artificial Sequence
  derived and/or modified CDS sequence (opt4) from CCHFV(Kosova Hoti, Artificial)__EU037902.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccagaagggcagaggccacgugaagcugagcagaggcagcgagguggugcuggacgccugcgacagcaacugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccaagaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugcccccagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8950 - RNA, 2916 nt, Artificial Sequence
  derived and/or modified CDS sequence (opt4) from CCHFV(YL04057, Artificial)__FJ562094.1__Gn-4aa-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagagagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcagaaagccccuguuccuggacagcaucgccaagggcaagaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcagccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcauccugcuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 8951 - RNA, 2916 nt, Artificial Sequence
  derived and/or modified CDS sequence (opt4) from CCHFV(V42/81, Artificial)__GU477490.1__Gn-4aa-Gc
agcaaggagcccggcgacgacugcaucagcagaacccagcugaugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaaggccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccuggagugcccccacaucccccugcugggcaagcuggccaucuacaucugcagaaugagcaaccaccccagaaccaccauggccuuccuguucugguucggcuucggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggugcugaagagaagcagcuggcugaucgugcugcuggugcugcugaccgugagccugagccccgugcagagcgcccccgugggcagaaagccccuguuccuggacagcaucgugaagggcaagaagaaccugcugaacagcaccagccuggagaccagccugagcaucgaggcccccuggggcgccaucaacauccagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaucgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgagaccccccagcuggaccugaaggccagacccgccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggagagcggcaccgacagcaccuucaaggccuucagcgccaugcccaagaccagccugugcuucuacaucguggagagagaguacugcaagagcugcagcgaggacgacacccagaagugcguggagaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggaggacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8952 - RNA, 2916 nt, Artificial Sequence
  derived and/or modified CDS sequence (opt4) from CCHFV(79121M18, Artificial)__GU477493.1__Gn-4aa-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagggccugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggcagaaagccccuguuccuggacagcaccgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagaucuaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 8953 - RNA, 2916 nt, Artificial Sequence
  derived and/or modified CDS sequence (opt4) from CCHFV(Afg09-2990, Artificial)__HM452306.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuaccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8954 - RNA, 2916 nt, Artificial Sequence
  derived and/or modified CDS sequence (opt4) from CCHFV(Sudan Al-Fulah 3-2008, Artificial)__HQ378184.1__Gn-4aa-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgugaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucagacaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagaaggaguacugcaagagcugcagcgaggaggacaccaagaagugcgugaacaccaagcuggagcagccccagagcauccugaucgagcacaagggcaccaucaucggcaagcagaacagcaccugcaccgccaaggugagcugcuggcuggagagcgccaagagcuucuucuacggccugaaggacaugcugagcggcaucuucggcaacguguucaucggcaucuuccuguuccuggcccccuucgugcugcuggugcuguucuucauguucggcuggagaauccugcugugcuucagaugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaaagaucgccgagcuguucagcaccaagacccacaucggc

SEQ ID NO: 8955 - RNA, 2916 nt, Artificial Sequence
  derived and/or modified CDS sequence (opt4) from CCHFV(Sudan AB1-2009, Artificial)__HQ378187.1__Gn-4aa-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuaccugaucaccugcauccugugcaaggccaucuucuaccugcugaucaucaucggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaaagccccuguuccuggacagcaucgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcaacgaggaggacaccaagaagugcgugaacaccaagcuggagcagccccagagcauccugaucgagcacaagggcaccaucaucggcaagcagaacagcaccugcaccgccagagccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8956 - RNA, 2916 nt, Artificial Sequence
  derived and/or modified CDS sequence (opt4) from CCHFV(NIVA 118595, Artificial)__JN572083.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggugaucuucuaccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcaucgcccugaagagaagcagcuggcugaucgugcugcuggugcuguucaccgugagcaucacccccgugcagagcgcccccaucggcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggagagcggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8957 - RNA, 2916 nt, Artificial Sequence
  derived and/or modified CDS sequence (opt4) from CCHFV(NIV 112143, Artificial)__JN572085.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggugaucuucuaccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcaucgcccugaagagaagcagcuggcugaucgugcugcuggugcuguucaccgugagcaucacccccgugcagagcgcccccaucggcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8958 - RNA, 2916 nt, Artificial Sequence
  derived and/or modified CDS sequence (opt4) from CCHFV(SCT ex Afghanistan, Artificial)__KC344856.1__Gn-4aa-Gc
agcgaggagagcggcgacgacugcaucagcagaacccagcugcugagaaccgagaccgccgaggugcacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcaagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggugaucuucuaccugcugaucguggugggcacccugggcaagaaguucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggcagaaagccccuguuccugaacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagagccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaagcugaacggccacaugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgacaucagcggccugaaguucgccagccugaccugcgccggcugcuacgccugcagcagcggcaucagcugcaaggugagaauccacguggacgagcccgacgagcugaccgugcacgugaagagcgaggaccccgacaucguggccgccagcaccagccugaucgccagaaagcuggagcugggcaccgacagcaccuucaaggccuucagcgccaugcccaagaccagccugugcuucuacaucguggagagagaguacugcaagagcugcagcaaggaggacacccagaagugcgugaacaccaagcuggagcacccccagggcauccugaucgagcacaagggcaccaucaucggcaagcagaacgacaccugcaccgccaaggccggcugcuggcuggagagcgugaagagcuucuucuacggccugaagaacaugcugagcggcaucuucggcaacguguucaucggcaucuuccuguuccuggcccccuucgugcugcugauccuguucuucauguucggcuggagacugcuguucugcuucaagugcugcagaagaaccagaggccuguucaaguacagacaccugaaggaggacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 8959 - RNA, 2916 nt, Artificial Sequence
  derived and/or modified CDS sequence (opt4) from CCHFV(Zahedan 2007, Artificial)__KC867273.1__Gn-4aa-Gc
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuucugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggcagaagaccccuguuccuggacagcaucgugaaggacaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugaucuucuucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8960 - RNA, 2916 nt, Artificial Sequence
  derived and/or modified CDS sequence (opt4) from CCHFV(SPU 44/08, Artificial)__KJ682805.1__Gn-4aa-Gc
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 8961 - RNA, 2916 nt, Artificial Sequence
  derived and/or modified CDS sequence (opt4) from CCHFV(SPU 383/87, Artificial)__KJ682806.1__Gn-4aa-Gc
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcuggugguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugauccagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucuucggcaagcagaacgacaccugcaccgccaaggccagcugcuggcuggagagcgugaagagcuucuucuacggccugaagaacaugcugagcggcaucuucggcaacguguucaucggcguguuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 8962 - RNA, 2916 nt, Artificial Sequence
  derived and/or modified CDS sequence (opt4) from CCHFV(SPU 130/89, Artificial)__KJ682807.1__Gn-4aa-Gc
agcgaggagcccaacuacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagcagaaagccccugagccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagagcacugcaagagcugcagcaaggaggacacccagagaugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcguguuccuguuccuggcccccuucaucauccugauccuguucuucauguucggcuggagaauccuguucugcuucaagugcugcagaagaaccagaggccugcugaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 8963 - RNA, 2916 nt, Artificial Sequence
  derived and/or modified CDS sequence (opt4) from CCHFV(SPU 497/88, Artificial)__KJ682808.1__Gn-4aa-Gc
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcaagggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagcagaaagccccuguuccuggacagcaucgugaagggcaugagaaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccagagccagcugcuggcuggagagcaucaagagcuucuucuacggccugaagaacaugcugagcggcaucuucggcaacguguucaucggcaucuuccuguucuucgcccccuucaucaugcugauccuguucuucauguucggcuggagaauccuguucugcuucaagugcugcagaagaaccagaggccuguucaaguacagacaccugaaggacgacgaggaggugggcuacagaaagaucaucgagagacugaacaacaagaagggcaagaacaagcugcuggacggcgagagacuggccgacagaaagaucgccgagcuguucagcaccaagacccacaucggc

SEQ ID NO: 8964 - RNA, 2916 nt, Artificial Sequence
  derived and/or modified CDS sequence (opt4) from CCHFV(SPU 18/88, Artificial)__KJ682810.1__Gn-4aa-Gc
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugggcuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagcagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccggcaaggccggcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaagaacaagaagggcaagaacaagcugcuggacggcgagagacuggccgacagaaagaucgccgagcuguucagcaccaagacccacaucggc

SEQ ID NO: 8965 - RNA, 2916 nt, Artificial Sequence
  derived and/or modified CDS sequence (opt4) from CCHFV(SPU 431/85, Artificial)__KJ682812.1__Gn-4aa-Gc
agcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggcagaaagccccuguuccuggacagcaucgugaagggcagaaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 8966 - RNA, 2916 nt, Artificial Sequence
  derived and/or modified CDS sequence (opt4) from CCHFV(SPU 48/90, Artificial)__KJ682813.1__Gn-4aa-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgugaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaccaccaccauggccuuccuguucugguucagcuucggcuacgugaucaccugcauccugugcaaggccaucuucuaccugcugaucaucaucggcacccugggcaagagauucagacaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaaagccccuguucagagacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaacagagccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagaaggaguacugcaagagcugcagcgaggaggacaccaagaagugcgugaacaccaagcuggagcagccccagagcauccugaucgagcacaagggcaccaucaucggcaagcagaacagcaccugcaccgccaaggugagcugcuggcuggagagcgccaagagcuucuucuacggccugaaggacaugcugagcggcaucuucggcaacguguucaucggcaucuuccuguuccuggcccccuucauccugcugauccuguucuucauguucggcuggagaauccugcugugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8967 - RNA, 2916 nt, Artificial Sequence
  derived and/or modified CDS sequence (opt4) from CCHFV(SPU 187/90, Artificial)__KJ682814.1__Gn-4aa-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaucuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaagaccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8968 - RNA, 2916 nt, Artificial Sequence
  derived and/or modified CDS sequence (opt4) from CCHFV(Haskovo-V46/13, Artificial)__KR092379.1__Gn-4aa-Gc
agcgaggagcugggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagaggcaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugcccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccaagcuggagcagccccagagcauccugaucgagcacaagggcaccaucaucggcaagcagaacgacaccugcaccgccagagccagcugcuggcuggagagcgugaagagcuucuucuacggccugaagaacaugcugggcagcguguucggcaacuuccugaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8969 - RNA, 2916 nt, Artificial Sequence
  derived and/or modified CDS sequence (opt4) from CCHFV(24-R-2012, Artificial)__KR814856.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8970 - RNA, 2916 nt, Artificial Sequence
  derived and/or modified CDS sequence (opt4) from CCHFV(36-ST-2014, Artificial)__KR814857.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaaguuccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggc

SEQ ID NO: 8971 - RNA, 2916 nt, Artificial Sequence
  derived and/or modified CDS sequence (opt4) from CCHFV(37-R-2013, Artificial)__KR814858.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgugaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8972 - RNA, 2916 nt, Artificial Sequence
  derived and/or modified CDS sequence (opt4) from CCHFV(44-ST-2010, Artificial)__KR814859.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccugcugugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggc

SEQ ID NO: 8973 - RNA, 2916 nt, Artificial Sequence
  derived and/or modified CDS sequence (opt4) from CCHFV(46-ST-2012, Artificial)__KR814860.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8974 - RNA, 2916 nt, Artificial Sequence
  derived and/or modified CDS sequence (opt4) from CCHFV(47-ST-2013, Artificial)__KR814861.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgagugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8975 - RNA, 2916 nt, Artificial Sequence
  derived and/or modified CDS sequence (opt4) from CCHFV(52-R-2014, Artificial)__KR814862.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacgugccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccggcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8976 - RNA, 2916 nt, Artificial Sequence
  derived and/or modified CDS sequence (opt4) from CCHFV(75-R-2012, Artificial)__KR814863.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcgcccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuuccuguacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8977 - RNA, 2916 nt, Artificial Sequence
  derived and/or modified CDS sequence (opt4) from CCHFV(75-ST-2010, Artificial)__KR814864.1__Gn-4aa-Gc
agcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8978 - RNA, 2916 nt, Artificial Sequence
  derived and/or modified CDS sequence (opt4) from CCHFV(3756-ST-2007, Artificial)__KR814866.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccugacccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8979 - RNA, 2916 nt, Artificial Sequence
  derived and/or modified CDS sequence (opt4) from CCHFV(3809-ST-2007, Artificial)__KR814867.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcagaagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccugacccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8980 - RNA, 2916 nt, Artificial Sequence
  derived and/or modified CDS sequence (opt4) from CCHFV(3820-ST-2007, Artificial)__KR814868.1__Gn-4aa-Gc
agcgaggagcccggcgacgacugcaucagcagaacccagcugcugaagaccgagaccgccgagauccacgacgacaacuacggcagccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcuggccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8981 - RNA, 2916 nt, Artificial Sequence
  derived and/or modified CDS sequence (opt4) from CCHFV(4495-ST-2008, Artificial)__KR814869.1__Gn-4aa-Gc
agcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagagaugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 8982 - RNA, 2916 nt, Artificial Sequence
  derived and/or modified CDS sequence (opt4) from CCHFV(4691-ST-2009, Artificial)__KR814871.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccgccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8983 - RNA, 2916 nt, Artificial Sequence
  derived and/or modified CDS sequence (opt4) from CCHFV(4701-ST-2009, Artificial)__KR814872.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcggcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8984 - RNA, 2916 nt, Artificial Sequence
  derived and/or modified CDS sequence (opt4) from CCHFV(5170-R-2011, Artificial)__KR814873.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8985 - RNA, 2916 nt, Artificial Sequence
  derived and/or modified CDS sequence (opt4) from CCHFV(Oman-199809166, Artificial)__KR864901.1__Gn-4aa-Gc
agcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggcagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 8986 - RNA, 2916 nt, Artificial Sequence
  derived and/or modified CDS sequence (opt4) from CCHFV(200406546-Turkey, Artificial)__KR864902.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugaucgaccugggcugcccccacgugccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaaguucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugaccgccagaaagcuggaguucggcaccgacagcaccuucaaggccuucagcgccaugcccaagaccagccugugcuucuacaucguggagaaggaguacugcaagagcugcaacgaggacgacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacaagagaaucaucgagagacugaacaacaagaagggcaagaacagacugcuggacggcgagagacuggccgacagaaagaucgccgagcuguucagcaccaagacccacaucggc

SEQ ID NO: 8987 - RNA, 2916 nt, Artificial Sequence
  derived and/or modified CDS sequence (opt4) from CCHFV(1-CR/HU-2015, Artificial)__KU161584.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8988 - RNA, 2916 nt, Artificial Sequence
  derived and/or modified CDS sequence (opt4) from CCHFV(Gaib, Artificial)__KX013445.1__Gn-4aa-Gc
agcgaggagagcagcgacgacugcaucagcagaacccagcugcugagaaccgagaccgccgagauccacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggccaucuucuaccugcugaucaucgugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacguggugcacugccccaagagaaaggagaagaucgaggagaccgagcuguaccugaaccuggagagagugcccuggguggugagaaagcugcugcaggugagcgagagcaccggcguggcccugaagagaagcagcuggcugaucgugcugcuggugcugcugaccgugagccugagccccgugcagagcgcccccaucggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugagcggcagaagcgagagcaucaugaagcuggaggagagaaccggcaucagcugggaccugggcguggaggacgccagcgagagcagacugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcagagaggacacccagaagugcgugagcaccaagcuggagcagccccagagcauccugaucgagcacaagggcaccaucaucggcaagcagaacaacaccugcaccaccaagaccaccugcuggcuggagagcgugaagagcuucuucuacggccugaagaacaugcugagcagcaucuucggcaacguguucgugggcaucuucagcuuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagagcaagcugcuggacggcgagagacuggccgacagaaagaucgccgagcuguucagcaccaagacccacaucggc

SEQ ID NO: 8989 - RNA, 2916 nt, Artificial Sequence
  derived and/or modified CDS sequence (opt4) from CCHFV(Hodzha, Artificial)__KX013448.1__Gn-4aa-Gc
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccgagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggcagaagaccccuguuccuggacagcaucgugaagggcaagaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugcagcgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcagaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8990 - RNA, 2916 nt, Artificial Sequence
  derived and/or modified CDS sequence (opt4) from CCHFV(IbAn7620, Artificial)__KX013451.1__Gn-4aa-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugagaaucacccaggagggcagaggccacgugaagcugagcagaggcagcgagaucgugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaaagccccuguuccuggacagcaucgccaagggcaugaagaacccccugaacagcaccagccuggagaccagccugagcaucgaggcccccuggggcgccaucgacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccaacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8991 - RNA, 2916 nt, Artificial Sequence
  derived and/or modified CDS sequence (opt4) from CCHFV(K128_76, Artificial)__KX013454.1__Gn-4aa-Gc
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucagcagaagaccccuguuccaggacagcaucgugaagggcaugaagaaccugcugaacagcaccagccuggagaccagccugagcaucgaggcccccuggggcgccaucaacgugcagagcaccuacaagcccgccgugagcgccgccaacaucgcccugagcuggagcagcguggagcacagaggcagcaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggagaacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8992 - RNA, 2916 nt, Artificial Sequence
  derived and/or modified CDS sequence (opt4) from CCHFV(K168_40, Artificial)__KX013457.1__Gn-4aa-Gc
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggcagaagaccccuguuccuggacggcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8993 - RNA, 2916 nt, Artificial Sequence
  derived and/or modified CDS sequence (opt4) from CCHFV(K168_125, Artificial)__KX013460.1__Gn-4aa-Gc
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaaggugccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggcagaagaccccuguuccuggacagcaucgugaagggcaagaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 8994 - RNA, 2916 nt, Artificial Sequence
  derived and/or modified CDS sequence (opt4) from CCHFV(K229_194, Artificial)__KX013463.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaagggcaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaagaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacagcugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 8995 - RNA, 2916 nt, Artificial Sequence
  derived and/or modified CDS sequence (opt4) from CCHFV(K229_243, Artificial)__KX013466.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccugacccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 8996 - RNA, 2916 nt, Artificial Sequence
  derived and/or modified CDS sequence (opt4) from CCHFV(K315_14, Artificial)__KX013469.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaagcugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8997 - RNA, 2916 nt, Artificial Sequence
  derived and/or modified CDS sequence (opt4) from CCHFV(K323_27, Artificial)__KX013472.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaccgugcugcuggugcugcugaccgugagccugagccccgugcagagcgcccccgugggcagaaagccccuguuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccggccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaacgacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8998 - RNA, 2916 nt, Artificial Sequence
  derived and/or modified CDS sequence (opt4) from CCHFV(K340_6, Artificial)__KX013475.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcaccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacauccccccccugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccugagccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggaggugaccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacacuucaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 8999 - RNA, 2916 nt, Artificial Sequence
  derived and/or modified CDS sequence (opt4) from CCHFV(Mamon, Artificial)__KX013478.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugagcgacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccguggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaagaccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9000 - RNA, 2916 nt, Artificial Sequence
  derived and/or modified CDS sequence (opt4) from CCHFV(Min, Artificial)__KX013481.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9001 - RNA, 2916 nt, Artificial Sequence
  derived and/or modified CDS sequence (opt4) from CCHFV(Nakiwogo, Artificial)__KX013484.1__Gn-4aa-Gc
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcguggugugcaaggugcuguucuaccugcugaucgugaucggcacccugggcaagaagcugaagcaguacagagagcugaagccccagaccugcaucgugugcgagagcauccccgugaacgugaucgacgccgagaugcacgagcugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggcagaaagccccuguaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacgugcagcagagacugcccagcgagaucgugacccugcaccccaagaucgaggagggcuucuucgaccugaugcacgugcagaaggugcuguucugcaagcacagccugcaggccaccagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucgugaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagcugggcgccgacagcaccuucaaggccuucagcagcaugcccaagaacagccugugcuucuacaucguggagagagacuacugcagcagcugcaccgacgacgacacccagaagugcgugaacaccaagcuggagcacccccagagcauccugaucgagcacaagggcaccaucaucggcaagcagaacgacaccugccccaccaagaccagcugcuggcuggagagcgugaagagcuucuucuacggccugaagaacaugcugggcggcaucuucggcaacguguuccugggcaucuuccuguuccuggcccccuucgcccugcugauccuguucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggc

SEQ ID NO: 9002 - RNA, 2916 nt, Artificial Sequence
  derived and/or modified CDS sequence (opt4) from CCHFV(Saf, Artificial)__KX013487.1__Gn-4aa-Gc
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuaccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaugaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgugagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9003 - RNA, 2916 nt, Artificial Sequence
  derived and/or modified CDS sequence (opt4) from CCHFV(Ast199, Artificial)__KX056051.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaugcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 9004 - RNA, 2916 nt, Artificial Sequence
  derived and/or modified CDS sequence (opt4) from CCHFV(Ast149, Artificial)__KX056054.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggcccuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 9005 - RNA, 2916 nt, Artificial Sequence
  derived and/or modified CDS sequence (opt4) from CCHFV(Ast137, Artificial)__KX056057.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccauccacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 9006 - RNA, 2916 nt, Artificial Sequence
  derived and/or modified CDS sequence (opt4) from CCHFV(Ast133, Artificial)__KX056060.1__Gn-4aa-Gc
agcgaggagcccgacgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcagcaagacccacaucggc

SEQ ID NO: 9007 - RNA, 2916 nt, Artificial Sequence
  derived and/or modified CDS sequence (opt4) from CCHFV(SK/2015/human, Artificial)__KX458183.1__Gn-4aa-Gc
agcgaggagagcggcgacgacugcaucagcagaaccagacugcugagaaccgagaccgccgagauccacggcgacagcuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugagaugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaccaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaagaccccuguuccuggacagcaucgugagaggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcgugagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccagggcagacagugcagccugaucgaggccggcaccagauucaaccugggcagcgugaccaucacccugagcgagcccagaaacauccagcacaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacagaggcaccaucaucggcaagcagaacaacaccugcaucgccaaggccagcugcuggcuggagagcgugaagagcuucuucuacggccugaagaacaugcugagcggcaucuucggcaaccuguuccugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9008 - RNA, 2916 nt, Artificial Sequence
  derived and/or modified CDS sequence (opt4) from CCHFV(YL16070, Artificial)__KY354081.1__Gn-4aa-Gc
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugaagagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgugugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaugagccccgugcagagcgcccccgugggcagaaagccccuguuccuggacagcaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcugaagagcuucaagggcuucuucuacggccugaagaacaugcugagcggcaucuucggcaacguguuccugggcauccugcuguuccuggcccccuucgugcugcugaucuucuucuucuucuucggcuggagacugcuguucugccugaagugcugcaagaagaccaagggccugcugaaguacaagcaccugaaggacaaggaggaggccggcuacaagaagaucaucgagagacugaacggcaagaagggcaagagccagcuguucgacggcgagagacuggccaacagaaagaucgccgagcuguucagcaccaagauccacaucggc

SEQ ID NO: 9009 - RNA, 2916 nt, Artificial Sequence
  derived and/or modified CDS sequence (opt4) from CCHFV(Oman_812956, Artificial)__KY362518.1__Gn-4aa-Gc
agcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggcagaaagccccuguucuucgacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9010 - RNA, 2916 nt, Artificial Sequence
  derived and/or modified CDS sequence (opt4) from CCHFV(UCCR4405, Artificial)__KY484029.1__Gn-4aa-Gc
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggcagaaagccccuguuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9011 - RNA, 2916 nt, Artificial Sequence
  derived and/or modified CDS sequence (opt4) from CCHFV(UCCR4401, Artificial)__KY484035.1__Gn-4aa-Gc
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggcagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggc

SEQ ID NO: 9012 - RNA, 2916 nt, Artificial Sequence
  derived and/or modified CDS sequence (opt4) from CCHFV(UCCR4448, Artificial)__KY484042.1__Gn-4aa-Gc
agcgaggagaccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccaucagccugagccccgugcagagcgcccccaucagcagaaagccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagaagaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagauccuggccgacagaagaaucgccgagcuguucagcaccaagacccacaucggc

SEQ ID NO: 9013 - RNA, 2916 nt, Artificial Sequence
  derived and/or modified CDS sequence (opt4) from CCHFV(SPU 45/88, Artificial)__KJ682809.1__Gn-4aa-Gc
agcgaggagagcagcgacgacugccugagcagaacccagcugcugagaaccgagaacaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugggcuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggaucgugagaaagcugcugcaggugagcgagagcaccggcguggcccugaagagaagcagcuggcugguggugcugcuggugcugcugaccgugagccugagccccgugcagagcgcccccaucggcagaaagccccuguuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaacgugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcauccugcuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 9014 - RNA, 2916 nt, Artificial Sequence
  derived and/or modified CDS sequence (opt4) from CCHFV(3010, Artificial)__DQ019222.1__Gn-4aa-Gc
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcaucgugugcaaggugcuguucuaccugcugaucgugaucggcacccugagcaagaagcugaagcaguacagagagcugaagccccagaccugcaucgugugcgagagcacccccgugaacgccaucgacgccgagaugcacgagcugaacugcaacuacaacaucugccccuacugcgccagcagacugaccagcgacggccuggugagacacgugaaccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggcagaagaccccuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9015 - RNA, 972 nt, Artificial Sequence
  derived and/or modified CDS sequence (opt4) from CCHFV(10200)__U39455.2__Gn
agcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9016 - RNA, 972 nt, Artificial Sequence
  derived and/or modified CDS sequence (opt4) from CCHFV(IbAr10200)__AF467768.2__Gn
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugagaagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9017 - RNA, 972 nt, Artificial Sequence
  derived and/or modified CDS sequence (opt4) from CCHFV(Turkey-Kelkit06)__GQ337054.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9018 - RNA, 972 nt, Artificial Sequence
  derived and/or modified CDS sequence (opt4) from CCHFV(SR3)__AJ538199.1__Gn
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggc

SEQ ID NO: 9019 - RNA, 972 nt, Artificial Sequence
  derived and/or modified CDS sequence (opt4) from CCHFV(UCCR4413)__KY484038.1__Gn
agcgagagcagcgccagcggcugcaucagcagaacccagaugaucaagagcgagaccgccgagauccacgacgacaucuacggcggccccggcgagaagcugaccaucugcaacggcaccaccgugguggaccagagacugggcagcgagcugggcugcuacaccaucaacagaaucaagaccuacaagcugugcgagaacagcgugaaggagaagaccugcgagaucgacagcgugcccgugaagugcagacagggccugugccugaagaucacccaggagggcagaggccacgugaagcugagcagaggcagcgagaucgugcuggacaucugcgacagcagcugcgagcugaugauccccaagggcaccggcgacauccugguggacugcagcggcggccagcagcacuuccugcaggacaaccugguggaccugggcugccccaacaucccccugcugggcaagguggccaucuacaucugcagaaugagcaaccaccccaagaccaccauggccuuccuguucugguucagcuucggcuacgugaucaccugcauccugugcaagauccuguucuaccugcugaucaucaccggcacccugggcaagaagcugaagcaguacagagagcugaagccccagaccugcaccaucugcgagagcacccccgugaacgccaucgacgccgagaugcacgaccugaacugcagcuacaacaucugccccuacugcgccagcagacugaccagcgacggccugaucagacacgugaaccugugccccaagagaaaggagaagguggaggagaccgagcuguaccugaaccuggagagaauccccugguucgugagaaagcugcugcaggugagcgagagcaccggcguggcccugaagagaagcagcuggcugcugauccuggugauccugcugaccgugagcaugagccccgugcagagcgcccccaucaac

SEQ ID NO: 9020 - RNA, 972 nt, Artificial Sequence
  derived and/or modified CDS sequence (opt4) from CCHFV(66019)__AB069669.1__Gn
agcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaacacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggc

SEQ ID NO: 9021 - RNA, 972 nt, Artificial Sequence
  derived and/or modified CDS sequence (opt4) from CCHFV(7001)__AB069670.1__Gn
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggc

SEQ ID NO: 9022 - RNA, 972 nt, Artificial Sequence
  derived and/or modified CDS sequence (opt4) from CCHFV(75024)__AB069671.1__Gn
agcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucggc

SEQ ID NO: 9023 - RNA, 972 nt, Artificial Sequence
  derived and/or modified CDS sequence (opt4) from CCHFV(7803)__AB069672.1__Gn
agcgaggagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgaggugauccuggacgccugcgacagcagcugcgaggugaugauccccaagggcaccggcgacauccugguggacugcagcggcggccagcagcacuuccugaaggacaaccugaucgaccugggcugccccagcaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccaucagccugagccccgugcagagcgcccccaucagc

SEQ ID NO: 9024 - RNA, 972 nt, Artificial Sequence
  derived and/or modified CDS sequence (opt4) from CCHFV(79121)__AB069673.1__Gn
gccgagggcggcagcagcgacugcaucagcagaacccagcuggugaagaccgagguggccgagauccacgaggacagcuacggcggccccggcgagaagaucaccaucugcaacggcagcaccaucguggaccagggccugggcagcgagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggc

SEQ ID NO: 9025 - RNA, 972 nt, Artificial Sequence
  derived and/or modified CDS sequence (opt4) from CCHFV(8402)__AB069674.1__Gn
agcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggc

SEQ ID NO: 9026 - RNA, 972 nt, Artificial Sequence
  derived and/or modified CDS sequence (opt4) from CCHFV(88166)__AB069675.1__Gn
agcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggc

SEQ ID NO: 9027 - RNA, 972 nt, Artificial Sequence
  derived and/or modified CDS sequence (opt4) from CCHFV(BA88166)__AF338470.1__Gn
agcgaggagagcggcgacgacugcaucagcagaacccagcugcugagaaccgagaccgccgagauccacagcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugggcuuccuguucugguucagcuucggcuacguggugaccugcauccugugcaagggcaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggc

SEQ ID NO: 9028 - RNA, 972 nt, Artificial Sequence
  derived and/or modified CDS sequence (opt4) from CCHFV(BA66019)__AF350448.1__Gn
agcgaggagagcggcgacgacugcaucagcagaacccagcugcugagaaccgagaccgccgaggugcacggcgacaacuacggcggccccggcgacaagaucaccaucugcaacggcagcaccaucguggaccagagacugggcagcgagcugggcugcuacaccaucaacagagugaagagcuucaagcugugcgagaacagcggcaccggcaagagcugcaagaucgacaagcaccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcaucuucugcaagaucaucuucuaccugcugaucguggugggcacccugggcaagaaguucaagcaguacagagagcugaagccccagaccugcaccaucugcgagaccacccccaccaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggc

SEQ ID NO: 9029 - RNA, 972 nt, Artificial Sequence
  derived and/or modified CDS sequence (opt4) from CCHFV(BA8402)__AF350449.1__Gn
agcgaggagagcggcgacgacugcaucagcagaacccagcugcugagaaccgagaccgccgagauccacaacgacaacuacggcggccccggcgacaagaucaccaucugcaacggcagcaccgugguggaccagagacugggcagcgagcugggcugcuacaccaucaacagagugaacagcuucaaccugugcgagaacaccgccaccggcaagagcugcgagaucgacagcacccccgugaagugcagacagggcuucugccugaagaucacccaggagggcagaggccacgugaagcugagcagaggcagcgagguggugcuggacgccugcgagagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacguggugaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacccaccagcgacggccuggccagacacgugaugcagugccccaagagaaaggagaagaucgaggagaccgcccuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggc

SEQ ID NO: 9030 - RNA, 972 nt, Artificial Sequence
  derived and/or modified CDS sequence (opt4) from CCHFV(Matin)__AF467769.2__Gn
agcgaggagagcggcgacgacugcaucagcagaacccagcugcugagaaccgagaccgccgagauccacagcgacagcuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggc

SEQ ID NO: 9031 - RNA, 972 nt, Artificial Sequence
  derived and/or modified CDS sequence (opt4) from CCHFV(Baghdad 12)__AJ538197.2__Gn
agcgaggagagcggcgacgacugcaucagcagaaccagacugcugagaaccgagaccgccgagauccacggcgacagcuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcaagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcuggccgugagcagcagccccgugcagagcgcccccaucggc

SEQ ID NO: 9032 - RNA, 972 nt, Artificial Sequence
  derived and/or modified CDS sequence (opt4) from CCHFV(VLG/TI29414)__AY179961.1__Gn
agcgaggagcccggcgacgacugcaucagcagaacccagcugcugagagccgagcccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaacgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9033 - RNA, 972 nt, Artificial Sequence
  derived and/or modified CDS sequence (opt4) from CCHFV(TADJ/HU8966)__AY179962.1__Gn
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugaagaucacccaggagggcagaggccacgugaagcugagcagaggcagcgagguggugcuggacgccugcgacagcagcugcgaggugaugauccccaagggcaccggcgacaucagcguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccagaauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagagaguggaggagaccgagcuguaccugaaccuggagagaauccccuggaucgugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9034 - RNA, 972 nt, Artificial Sequence
  derived and/or modified CDS sequence (opt4) from CCHFV(Hodzha)__AY223476.1__Gn
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcaagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggc

SEQ ID NO: 9035 - RNA, 972 nt, Artificial Sequence
  derived and/or modified CDS sequence (opt4) from CCHFV(Kosovo/9553/2001)__AY675511.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucgccagaaugagcaaccaccccaagaccaccauggccuuccuguucugguucagccugggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9036 - RNA, 972 nt, Artificial Sequence
  derived and/or modified CDS sequence (opt4) from CCHFV(SPU41/84)__AY900142.1__Gn
agcgaggagagcagcgacgacugcaucagcagaacccagcugcugagaaccgagaccgccgagauccacggcgacaacuacggcggccccggcgacaagaucaccaucugcaacggcagcaccgugguggaccagagacugggcagcgagcugggcugcuacaccaucaacagagugaagaccuucaagcugugcgagaacagcgccaccggcaagagcugcgagaucgacagcgugcccgugaagugcagacagggcuacugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucaucugcaaggugaucuucuaccugcugaucaucgugggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagc

SEQ ID NO: 9037 - RNA, 972 nt, Artificial Sequence
  derived and/or modified CDS sequence (opt4) from CCHFV(UG3010)__AY900143.1__Gn
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcaucgugugcaaggugcuguucuaccugcugaucgugaucggcacccugagcaagaagcugaagcaguacagagagcugaagccccagaccugcaucgugugcgagagcacccccgugaacgccaucgacgccgagaugcacgagcugaacugcaacuacaacaucugccccuacugcgccagcagacugaccagcgacggccuggugagacacgugaaccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggc

SEQ ID NO: 9038 - RNA, 972 nt, Artificial Sequence
  derived and/or modified CDS sequence (opt4) from CCHFV(Hy13)__AY900145.1__Gn
agcgaggagagcggcgacgacugcaucagcagaacccagcugagcagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccaucaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucggc

SEQ ID NO: 9039 - RNA, 972 nt, Artificial Sequence
  derived and/or modified CDS sequence (opt4) from CCHFV(Semunya)__DQ094832.1__Gn
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcguggugugcaaggugcuguucuaccugcugaucgugaucggcacccugggcaagaagcugaagcaguacagagagcugaagccccagaccugcaucgugugcgagagcauccccgugaacgccaucgacgccgagaugcacgagcugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggc

SEQ ID NO: 9040 - RNA, 972 nt, Artificial Sequence
  derived and/or modified CDS sequence (opt4) from CCHFV(SPU128/81/7)__DQ157174.1__Gn
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgagagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9041 - RNA, 972 nt, Artificial Sequence
  derived and/or modified CDS sequence (opt4) from CCHFV(ROS/HUVLV-100)__DQ206448.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9042 - RNA, 972 nt, Artificial Sequence
  derived and/or modified CDS sequence (opt4) from CCHFV(AP92)__DQ211625.1__Gn
agcgagggcggcgacggcggcugcaucagcagaacccagcugaucaagaccgagaccgccgaggugcacggcgacgacuacggcggccccggcgagaagaucaccaucugcaacggcagcaccaucguggaccagagacugggcagcgagcugggcugcuacaccaucaacagaaucaagagcuucaagcugugcgagaacagcgcccagggcaagaacugcgagaucgacagcgcccccgugcagugcagacagggcuacugccugaagaucagccaggagggcagaggccacgugaagcugagcagaggcagcgagaucgugcuggacgugugcgacaccagcugcgagaucaugauccccaagggcaccggcgacauccugguggacugcagcggcggccagcagcacuuccugcagagcaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaagacccuguucuacauccugaucaucaucggcacccugggcaagaagcugaagcaguacagagagcugaagccccagaccugcaccaucugcgagagcgugcccgugaacgccaucgacgccgagaugcacgaccugaacugcagcuacaacaucugccccuacugcgccagcagacugaccagcgagggccugaccagacacgugaaccagugccccaagagaaaggagaagguggaggagaccgagcuguaccugaaccuggagagaauccccuggaucgugagaaagcugcugcaggugagcgagagcaccggcguggcccugaagagaagcagcuggaugaucgugcugcugauccugcugaucgugagcaugagccccgugcagagcgcccccaucagc

SEQ ID NO: 9043 - RNA, 972 nt, Artificial Sequence
  derived and/or modified CDS sequence (opt4) from CCHFV(ArD8194)__DQ211626.1__Gn
gccgagggcggcagcaacgacugcgugagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugagaaccuacaagcugugcgagaacagcgccaccgagaagagcugcgagaucgacagcgugcccgugaagugcaagcagggcuucugccugaagaucacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacaucccccugcugggcagaaccgccaucuacgugugcagaaugagcaaccaccccaagaccaccauggccuuccuguucugguucagcuucggcuacgugaucaccugcguggugugcaaggugcuguucuaccugcugaucgugaucggcacccugggcaagagacugaagcaguacagagagcugaagccccagaccugcaucgugugcgagagcauccccgugaacgccaucgacgccgagaugcacgaccugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaaagcugcugcaggugagcgagagcaccggcguggcccugaagagaagcugcuggaugaucacccugcugauccugcugaccgugagcaugagccccgugcagagcgcccccgugggc

SEQ ID NO: 9044 - RNA, 972 nt, Artificial Sequence
  derived and/or modified CDS sequence (opt4) from CCHFV(ArD15786)__DQ211627.1__Gn
gccgagggcggcagcaacgacugcgugagcagaacccagcuggugaagaccgaggugaccgagauccacgaggacagcuacggcggccccggcgagaagaucaccaucugcaacggcagcaccaucguggaccagagacugggcagcgagcugggcugcuacaccaucaacagagugagaaccuacaagcugugcgagaacagcgccaccgagaagagcugcgagaucgacagcgugcccgugaagugcaagcagggcuucugccugaagaucacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacaucccccugcugggccagaccgccaucuacgugugcagaaugagcaaccaccccaagaccaccauggccuuccuguucugguucagcuucggcuacgugaucaccugcguggugugcaaggugcuguucuaccugcugaucgugaucggcacccugggcaagagacugaagcaguacagagagcugaagccccagaccugcaucgugugcgagagcauccccgugaacgccaucgacgccgagaugcacgaccugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaaagcugcugcaggugagcgagagcaccggcguggcccugaagagaagcugcuggaucaucacccugcugauccugcugaccgugagcaugagccccgugcagagcgcccccgugggc

SEQ ID NO: 9045 - RNA, 972 nt, Artificial Sequence
  derived and/or modified CDS sequence (opt4) from CCHFV(ArD39554)__DQ211628.1__Gn
agcgagagcaacaacaacgacugcgugagcagaacccagcugaucaagaccgagaacgccgagauccacggcgacgacuacggcggccccggcgagaagaucaccaucugcaacggcagcaccaucguggagcagagacugggcagcgagcugggcugcuacaccaucaacagaaucaagagcuucaagcugugcgagaacagcgccagcggcaagggcugcgagaucgacagcacccccgugaagugcaagcagggcuucugccugaagaucacccaggagggcagaggccacgugaagcugagcagaggcagcgagaucauccuggacgugugcgacagcagcugcgagaugaugauccccaagggcagcggcgacauccugguggacugcagcggcggccagcagcacuuccugcaggacaaccugguggaccugggcugccccaacgugccccugcugggcaagauggccaucuacaucugcagaaugagcaaccaccccaagaccaccauggccuuccuguucugguucagcuucggcuacgugaucaccugcaucuucugcaaggugaucuucuacgugcugaucaucaucggcacccugggcaagagaaucaagcaguacagagagcugaagccccagaccugcaccaucugcgaggccacccccgugaacgccaucgacgccgagaugcacgaccugaacugcagcuacaacaucugccccuacugcgccagcagacugaccagcgagggccuggugagacacgugacccagugccccaagagaaaggagaagaucgaggagaccgagcuguaccugaaccuggagagaauccccugguucgugagaaagcugcugcaggugagcgagagcaccggcguggcccugaagagaagcagcuggcuggugacccugcuggugcugcugaccgugagccugagccccgugcagagcgcccccaucggc

SEQ ID NO: 9046 - RNA, 972 nt, Artificial Sequence
  derived and/or modified CDS sequence (opt4) from CCHFV(Drosdov)__DQ211630.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaagugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9047 - RNA, 972 nt, Artificial Sequence
  derived and/or modified CDS sequence (opt4) from CCHFV(Oman)__DQ211632.1__Gn
agcgaggagagcggcgaggacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacaacacccccgugaagugcaagcagggcuucugccugaagaucacccaggagggcagaggccacgugaagcugagcagagacagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccaucggc

SEQ ID NO: 9048 - RNA, 972 nt, Artificial Sequence
  derived and/or modified CDS sequence (opt4) from CCHFV(SPU97/85)__DQ211633.1__Gn
agcgaggagagcgacggcgacugcaucagcagaacccagcugcugagaaccgagaccgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcagcugcgagaucaugauccccaagggcaccggcgacauccugguggacugcagcggcggccagcagcacuuccugaaggacaaccugaucgaccugggcugccccaacaucccccugcugggcagaauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggc

SEQ ID NO: 9049 - RNA, 972 nt, Artificial Sequence
  derived and/or modified CDS sequence (opt4) from CCHFV(SPU103/87)__DQ211634.1__Gn
agcgaggagagcagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagaccuucaagcugugcgagaacagcgccaccggcaagagcugcgagaucgacagcgugcccgugaagugcagacagggcuacugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcgugcugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaagacugcugcaggugagcgagagcaccggcguggcccugaagagaagcagcuggcugaucgugcugcuggugcuguucaccgugagccugagccccgugcagagcgcccccaucagc

SEQ ID NO: 9050 - RNA, 972 nt, Artificial Sequence
  derived and/or modified CDS sequence (opt4) from CCHFV(SPU415/85)__DQ211635.1__Gn
agcgaggagagcgacggcgacugcaucagcagaacccagcugcugagaaccgagaccaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuucugccugaagaucacccaggagggcagaggccacgugaagcugagcagaggcagcgagaucgugcuggacgccugcgacagcaacugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggccggcaccgugggcaagaaguucaagcaguacagagagcugagaccccagaccugcaccaucugcgagaccauccccgugaacgccaucgacgccgagaugcacgaccugaacugcagcuacaacaucugccccuacugcgccagcagacugaccagcgacggccuggccagacacgugaugcagugccccaagagaaaggagaagguggaggagaccgagcuguaccugaaccuggagagaauccccuggguggugagaaagcugcugcaggugagcgagagcaccggcguggcccugaagagaagcagcuggcugaccgugcugcuggugcugcugaucgugagccugagccccgugcagagcgcccccaucggc

SEQ ID NO: 9051 - RNA, 972 nt, Artificial Sequence
  derived and/or modified CDS sequence (opt4) from CCHFV(Turkey200310849)__DQ211636.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucagcugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9052 - RNA, 972 nt, Artificial Sequence
  derived and/or modified CDS sequence (opt4) from CCHFV(Kosova Hoti)__EU037902.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccagaagggcagaggccacgugaagcugagcagaggcagcgagguggugcuggacgccugcgacagcaacugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccaagaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugaagcagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9053 - RNA, 972 nt, Artificial Sequence
  derived and/or modified CDS sequence (opt4) from CCHFV(YL04057)__FJ562094.1__Gn
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagagagcugggcugcuacaccaucaacagagugagaagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgccugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaucagccccgugcagagcgcccccgugggc

SEQ ID NO: 9054 - RNA, 972 nt, Artificial Sequence
  derived and/or modified CDS sequence (opt4) from CCHFV(V42/81)__GU477490.1__Gn
agcaaggagcccggcgacgacugcaucagcagaacccagcugaugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaaggccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccuggagugcccccacaucccccugcugggcaagcuggccaucuacaucugcagaaugagcaaccaccccagaaccaccauggccuuccuguucugguucggcuucggcuacgugaucaccugcauccugugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggugcugaagagaagcagcuggcugaucgugcugcuggugcugcugaccgugagccugagccccgugcagagcgcccccgugggc

SEQ ID NO: 9055 - RNA, 972 nt, Artificial Sequence
  derived and/or modified CDS sequence (opt4) from CCHFV(Afg09-2990)__HM452306.1__Gn
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuacugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuaccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggc

SEQ ID NO: 9056 - RNA, 972 nt, Artificial Sequence
  derived and/or modified CDS sequence (opt4) from CCHFV(Sudan Al-Fulah 3-2008)__HQ378184.1__Gn
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgugaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucagacaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9057 - RNA, 972 nt, Artificial Sequence
  derived and/or modified CDS sequence (opt4) from CCHFV(Sudan AB1-2009)__HQ378187.1__Gn
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuaccugaucaccugcauccugugcaaggccaucuucuaccugcugaucaucaucggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9058 - RNA, 972 nt, Artificial Sequence
  derived and/or modified CDS sequence (opt4) from CCHFV(NIVA 118595)__JN572083.1__Gn
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggugaucuucuaccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcaucgcccugaagagaagcagcuggcugaucgugcugcuggugcuguucaccgugagcaucacccccgugcagagcgcccccaucggc

SEQ ID NO: 9059 - RNA, 972 nt, Artificial Sequence
  derived and/or modified CDS sequence (opt4) from CCHFV(SCT ex Afghanistan)__KC344856.1__Gn
agcgaggagagcggcgacgacugcaucagcagaacccagcugcugagaaccgagaccgccgaggugcacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcaagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggugaucuucuaccugcugaucguggugggcacccugggcaagaaguucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccaucggc

SEQ ID NO: 9060 - RNA, 972 nt, Artificial Sequence
  derived and/or modified CDS sequence (opt4) from CCHFV(Zahedan 2007)__KC867273.1__Gn
agcgaggagagcggcgacgacugcaucagcagaacccagcugcugagaaccgagaccgccgaggugcacggcgacaacuacggcggccccggcgacaagaucaccaucugcaacggcagcaccgugguggaccagagacugggcagcgagcugggcugcuacaccaucaacagagugagaagcuucaagcugugcgagaacagcgccaccggcaagagcugcgagaucgacagcauccccgugaagugcaagcagggcuucugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugguggaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuuccugcugaucaucuucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccagaagaaaggagaagguggaggagaccgagcuguaccugaaccuggagagaauccccuggguggugagaaagcugcugcaggugagcgagagcaccggcaccgugcugaagagaagcagcuggcugaucgugcugcuggugcuguucaccgugagccugagccccgugcagagcgcccccaucggc

SEQ ID NO: 9061 - RNA, 972 nt, Artificial Sequence
  derived and/or modified CDS sequence (opt4) from CCHFV(SPU 44/08)__KJ682805.1__Gn
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagc

SEQ ID NO: 9062 - RNA, 972 nt, Artificial Sequence
  derived and/or modified CDS sequence (opt4) from CCHFV(SPU 383/87)__KJ682806.1__Gn
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcuggugguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugauccagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagc

SEQ ID NO: 9063 - RNA, 972 nt, Artificial Sequence
  derived and/or modified CDS sequence (opt4) from CCHFV(SPU 130/89)__KJ682807.1__Gn
agcgaggagcccaacuacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccauggccuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcugguggugcugcuggugcugcugaccgugagccugagccccgugcagagcgcccccaucagc

SEQ ID NO: 9064 - RNA, 972 nt, Artificial Sequence
  derived and/or modified CDS sequence (opt4) from CCHFV(SPU 497/88)__KJ682808.1__Gn
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcaagggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugguguuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagc

SEQ ID NO: 9065 - RNA, 972 nt, Artificial Sequence
  derived and/or modified CDS sequence (opt4) from CCHFV(SPU 18/88)__KJ682810.1__Gn
agcgaggagagcaacgacgacugccugagcagaacccagcugcugagaaccgagaacgccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugggcuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccaaccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggguggugagaaagcugcugcaggugagcgagagcaccggcguggcccugaagagaagcagcuggcuggugauccugcuggugcugcugaccgugagccugagccccgugcagagcgcccccaucagc

SEQ ID NO: 9066 - RNA, 972 nt, Artificial Sequence
  derived and/or modified CDS sequence (opt4) from CCHFV(SPU 48/90)__KJ682813.1__Gn
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgugaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaccaccaccauggccuuccuguucugguucagcuucggcuacgugaucaccugcauccugugcaaggccaucuucuaccugcugaucaucaucggcacccugggcaagagauucagacaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9067 - RNA, 972 nt, Artificial Sequence
  derived and/or modified CDS sequence (opt4) from CCHFV(SPU 187/90)__KJ682814.1__Gn
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9068 - RNA, 972 nt, Artificial Sequence
  derived and/or modified CDS sequence (opt4) from CCHFV(Haskovo-V46/13)__KR092379.1__Gn
agcgaggagcugggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagaggcaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugcccgugagccugagccccgugcagagcgcccccgugggc

SEQ ID NO: 9069 - RNA, 972 nt, Artificial Sequence
  derived and/or modified CDS sequence (opt4) from CCHFV(24-R-2012)__KR814856.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9070 - RNA, 972 nt, Artificial Sequence
  derived and/or modified CDS sequence (opt4) from CCHFV(36-ST-2014)__KR814857.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9071 - RNA, 972 nt, Artificial Sequence
  derived and/or modified CDS sequence (opt4) from CCHFV(44-ST-2010)__KR814859.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccugcugugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9072 - RNA, 972 nt, Artificial Sequence
  derived and/or modified CDS sequence (opt4) from CCHFV(47-ST-2013)__KR814861.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9073 - RNA, 972 nt, Artificial Sequence
  derived and/or modified CDS sequence (opt4) from CCHFV(52-R-2014)__KR814862.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacaccagcugcgaggugaugauccccaagggcaccggcgacauccugguggacugcagcggcggccagcagcacuuccugaaggacaaccugaucgaccugggcugcccccacgugccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9074 - RNA, 972 nt, Artificial Sequence
  derived and/or modified CDS sequence (opt4) from CCHFV(75-R-2012)__KR814863.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcgcccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9075 - RNA, 972 nt, Artificial Sequence
  derived and/or modified CDS sequence (opt4) from CCHFV(75-ST-2010)__KR814864.1__Gn
agcgaggagagcggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugccuguucugcaaggcccuguucuacagccugaucaucaucggcacccugggcaagaagaucaagcaguacagagagcugagaccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9076 - RNA, 972 nt, Artificial Sequence
  derived and/or modified CDS sequence (opt4) from CCHFV(3820-ST-2007)__KR814868.1__Gn
agcgaggagcccggcgacgacugcaucagcagaacccagcugcugaagaccgagaccgccgagauccacgacgacaacuacggcagccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcuggccgugagccugagccccgugcagagcgcccccgugggc

SEQ ID NO: 9077 - RNA, 972 nt, Artificial Sequence
  derived and/or modified CDS sequence (opt4) from CCHFV(4701-ST-2009)__KR814872.1__Gn
agcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9078 - RNA, 972 nt, Artificial Sequence
  derived and/or modified CDS sequence (opt4) from CCHFV(5170-R-2011)__KR814873.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9079 - RNA, 972 nt, Artificial Sequence
  derived and/or modified CDS sequence (opt4) from CCHFV(200406546-Turkey)__KR864902.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgaggugaugauccccaagggcaccggcgacauccugguggacugcagcggcggccagcagcacuuccugaaggacaaccugaucgaccugggcugcccccacgugccccugcugggcagaauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaaguucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9080 - RNA, 972 nt, Artificial Sequence
  derived and/or modified CDS sequence (opt4) from CCHFV(1-CR/HU-2015)__KU161584.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9081 - RNA, 972 nt, Artificial Sequence
  derived and/or modified CDS sequence (opt4) from CCHFV(Gaib)__KX013445.1__Gn
agcgaggagagcagcgacgacugcaucagcagaacccagcugcugagaaccgagaccgccgagauccacaacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcaucuucugcaaggccaucuucuaccugcugaucaucgugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacguggugcacugccccaagagaaaggagaagaucgaggagaccgagcuguaccugaaccuggagagagugcccuggguggugagaaagcugcugcaggugagcgagagcaccggcguggcccugaagagaagcagcuggcugaucgugcugcuggugcugcugaccgugagccugagccccgugcagagcgcccccaucggc

SEQ ID NO: 9082 - RNA, 972 nt, Artificial Sequence
  derived and/or modified CDS sequence (opt4) from CCHFV(Hodzha)__KX013448.1__Gn
agcgaggagagcggcgacgacugcaucagcagaacccagcugcugagaaccgagaccgccgagauccacggcgacgacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccagaaucccccugcugggcaagauggccaucuacaucugcagaaugagcaaccaccccgagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcuguucgccgugagccugagccccgugcagagcgcccccaucggc

SEQ ID NO: 9083 - RNA, 972 nt, Artificial Sequence
  derived and/or modified CDS sequence (opt4) from CCHFV(IbAn7620)__KX013451.1__Gn
agcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaacugcgagaucgacagcgugcccgugaagugcagacagggcuacugccugagaaucacccaggagggcagaggccacgugaagcugagcagaggcagcgagaucgugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9084 - RNA, 972 nt, Artificial Sequence
  derived and/or modified CDS sequence (opt4) from CCHFV(K128_76)__KX013454.1__Gn
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucagc

SEQ ID NO: 9085 - RNA, 972 nt, Artificial Sequence
  derived and/or modified CDS sequence (opt4) from CCHFV(K168_40)__KX013457.1__Gn
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggc

SEQ ID NO: 9086 - RNA, 972 nt, Artificial Sequence
  derived and/or modified CDS sequence (opt4) from CCHFV(K168_125)__KX013460.1__Gn
agcgacgagagcggcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagguggacagcauccccgugaagugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaaggugccccugcugggcaagauggccaucuacaucugcagaaugagcaaccaccccaagaccaccauggccuuccuguucugguucagcuucggcuacgugaucaccugcaucgugugcaaggccaucuucuaccugcugaucaucgugggcacccugggcaagagauucaagcaguacagagagcugaagccccagaccugcaccaucugcgagaccacccccaccaacgccaucgacgccgagaugcacgaccugaacugcagcuacaacaucugccccuacugcgccagcagacugaccagcgacggccuggccagacacgugacccacugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucgccgugagccugagccccgugcagagcgcccccaucggc

SEQ ID NO: 9087 - RNA, 972 nt, Artificial Sequence
  derived and/or modified CDS sequence (opt4) from CCHFV(K229_194)__KX013463.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaagggcaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9088 - RNA, 972 nt, Artificial Sequence
  derived and/or modified CDS sequence (opt4) from CCHFV(K315_14)__KX013469.1__Gn
agcgaggagcccggcgacgacugcaucagcagaacccagcugcugaagaccgagaccgccgagauccacgacgacaacuacggcggccccggcgacaagaucaccaucugcaacggcagcaccgugguggaccagagacugggcagcgagcugggcugcuacaccaucaacagagugaagagcuucaagcugugcaagaacagcgccaccggcaagaccugcgagaucgacagcacccccgugaagugcagacagggcuucugccugaagaucacccaggagggcagaggccacgugaagcugagcagaggcagcgagguggugcuggacgugugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgagggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9089 - RNA, 972 nt, Artificial Sequence
  derived and/or modified CDS sequence (opt4) from CCHFV(K323_27)__KX013472.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaccgugcugcuggugcugcugaccgugagccugagccccgugcagagcgcccccgugggc

SEQ ID NO: 9090 - RNA, 972 nt, Artificial Sequence
  derived and/or modified CDS sequence (opt4) from CCHFV(K340_6)__KX013475.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcaccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacauccccccccugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9091 - RNA, 972 nt, Artificial Sequence
  derived and/or modified CDS sequence (opt4) from CCHFV(Mamon)__KX013478.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugagcgacgccugcgacagcagcugcgaggugaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccguggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9092 - RNA, 972 nt, Artificial Sequence
  derived and/or modified CDS sequence (opt4) from CCHFV(Nakiwogo)__KX013484.1__Gn
gccgagggcgugagcaacgacugcgugagcagaacccagcugaucaagaccgagguggccgagauccacgaggacagcuacggcggccccggcgagaagaucaccaucugcaacggcagcaccaucguggaccagagacugggcagcgagcugggcugcuacaccaucaacagagugaagaccuacaagcugugcgagaacagcgccaccgagaagggcugcgagaucgacagcgugcccgugaagugcaagcagggcuucugccugaaggugacccaggagggcagaggccacgugaagcugagcagaggcaccgagaucgugcuggacgugugcgacaccagcugcgagcugaugauccccaagggcaccggcgacauccugguggacugcagcggcggccagcagcacuuccugcaggacaaccugaucgaccugggcugccccaacgugccccugcugggcaagauggccaucuacaucugcagaaugagcaaccaccccaagaccaccauggccuuccuguucugguucagcuucggcuacgugaucaccugcguggugugcaaggugcuguucuaccugcugaucgugaucggcacccugggcaagaagcugaagcaguacagagagcugaagccccagaccugcaucgugugcgagagcauccccgugaacgugaucgacgccgagaugcacgagcugaacugcaacuacaacaucugccccuacugcgccagcagacugaccagcgacggccuggugagacacgugacccagugccccaagagaaaggagaagguggaggagaccgagcuguaccugaaccuggagagaauccccuggcuggugagaagacugcugcaggugagcgagagcaccggcauggcccugaagagaagcugcuggaugaccacccugcugauccugcugguggugagccugagccccgugcagagcgcccccgugggc

SEQ ID NO: 9093 - RNA, 972 nt, Artificial Sequence
  derived and/or modified CDS sequence (opt4) from CCHFV(Saf)__KX013487.1__Gn
agcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuaccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugccccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9094 - RNA, 972 nt, Artificial Sequence
  derived and/or modified CDS sequence (opt4) from CCHFV(Ast199)__KX056051.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaugcagcuggcugaucgugcugcuggugcugcugaccgugagccugagccccgugcagagcgcccccgugggc

SEQ ID NO: 9095 - RNA, 972 nt, Artificial Sequence
  derived and/or modified CDS sequence (opt4) from CCHFV(Ast137)__KX056057.1__Gn
agcgaggagcccggcgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccauccacaucugcagaaugagcaaccaccccagaaccaccauggccuuccuguucugguucagcuucggcuacgugaucaccugcaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9096 - RNA, 972 nt, Artificial Sequence
  derived and/or modified CDS sequence (opt4) from CCHFV(Ast133)__KX056060.1__Gn
agcgaggagcccgacgacgacugcaucagcagaacccagcugcugaagaccgagaccgccgagauccacgacgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagaccugcgagaucgacagcacccccgugaagugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugaucgaccugggcugcccccacaucccccugcugggcaagauggccaucuacaucugcagaaugagcaaccaccccagaaccaccauggccuuccuguucugguucagcuucggcuacgugaucaccugcaucuucugcaaggcccuguucuaccugcugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggugagcgagagcaccggcguggcccugaagagaagcagcuggcugaucgugcugcuggugcugcugaccgugagccugagccccgugcagagcgcccccgugggc

SEQ ID NO: 9097 - RNA, 972 nt, Artificial Sequence
  derived and/or modified CDS sequence (opt4) from CCHFV(SK/2015/human)__KX458183.1__Gn
agcgaggagagcggcgacgacugcaucagcagaaccagacugcugagaaccgagaccgccgagauccacggcgacagcuacggcggccccggcgacaagaucaccaucugcaacggcagcaccaucguggaccagagacugggcagcgagaugggcugcuacaccaucaacagagugaagagcuucaagcugugcgagaacagcgccaccggcaagagcugcgagaucgacagcauccccgugagaugcagacagggcuacugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugccccaacaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucgugggcacccugggcaagagauucaagcaguacagagagcugaagccccagaccugcaccaucugcgagaccacccccgccaacgccaucgacgccgagaugcacgaccugaacugcagcuacaccaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccgugagccugagccccgugcagagcgcccccaucggc

SEQ ID NO: 9098 - RNA, 972 nt, Artificial Sequence
  derived and/or modified CDS sequence (opt4) from CCHFV(YL16070)__KY354081.1__Gn
gccgagggcggcagcagcgacugcaucagcagaacccagcuggugaagaccgagguggccgagauccacgaggacagcuacggcggccccggcgagaagaucaccaucugcaacggcagcaccaucguggaccagagacugggcagcgagcugggcugcuacaccaucaacagagugaagagcuacaagcugugcgagaacagcgccagcggcaagagcugcgagaucgacagcauccccgugaagugcaagcagggcuucugccugaagaucacccaggagggcagaggccacgugaagcugagcagaggcaccgagaucgugcuggacgugugcgacagcagcugcgagcugaugauccccaagggcaccggcgacauccugguggacugcagcggcggccagcagcacuuccugcagaacaaccugaucgaccugggcugccccaacgugccccugcugggcaagauggccaucuacgugugcagaaugagcaaccaccccaagaccaccauggccuuccuguucugguucagcuucggcuacgugaucaccugcaucgugugcagagugcuguucuaccugcugaucgccaucggcaccgugggcaagaagcugaagcaguacagagagcugaagccccagaccugcaucgugugcgagagcgugcccgugaacgccaucgacgccgagaugcacgagcugaacugcagcuacaacaucugccccuacugcgccagcagacugagcaccgacggccugaucagacacgugacccagugccccaagagaagagagaagguggaggagaccgagcuguuccugaaccuggagagaauccccuggcuggugagaaagcugcugcaggugagcgagagcaccggcauggcccugaagagaagcugcuggaugaucacccugcugauccugcugcuggugagcaugagccccgugcagagcgcccccgugggc

SEQ ID NO: 9099 - RNA, 972 nt, Artificial Sequence
  derived and/or modified CDS sequence (opt4) from CCHFV(UCCR4448)__KY484042.1__Gn
agcgaggagaccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccugcauccugugcaaggccaucuucuaccugcugaucaucaucggcacccugggcaagagauucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggguggugagaaagcugcugcaggugagcgagagcaccggcguggcccugaagagaagcagcuggcugaucgugcugcuggugcuguucaccaucagccugagccccgugcagagcgcccccaucagc

SEQ ID NO: 9100 - RNA, 972 nt, Artificial Sequence
  derived and/or modified CDS sequence (opt4) from CCHFV(SPU 45/88)__KJ682809.1__Gn
agcgaggagagcagcgacgacugccugagcagaacccagcugcugagaaccgagaacaccgagauccacagcgacaacuacggcggccccggcgacaagaucaccaucugcaacggcagcaccaucguggaccagagacugggcagcgagcugggcugcuacaccaucaacagagugaagagcuucaagcugugcgagaacagcgccaccggcaagagcugcgagaucgacagcacccccgugagaugcagacagggcuucugccugaagaucacccaggagggcagaggccacgugaagcugagcagaggcagcgagguggugcuggacgccugcgacagcagcugcgagaucaugauccccaagggcaccggcgacauccugguggacugcagcggcggccagcagcacuuccugaaggacaaccugguggaccugggcugccccaacaucccccugcugggcaagauggccaucuacaucugcagaaugagcaaccaccccaagaccaccaugggcuuccuguucugguucagcuucggcuacgugaucaccugcauccugugcaaggugaucuucuaccugcugaucguggugggcacccugggcaagaaguucaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugaugcagugccccaagagaaaggagaagaucgaggagaccgagcuguaccugaaccuggagagaauccccuggaucgugagaaagcugcugcaggugagcgagagcaccggcguggcccugaagagaagcagcuggcugguggugcugcuggugcugcugaccgugagccugagccccgugcagagcgcccccaucggc

SEQ ID NO: 9101 - RNA, 1932 nt, Artificial Sequence
  derived and/or modified CDS sequence (opt4) from CCHFV(10200)__U39455.2__Gc
uuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggc

SEQ ID NO: 9102 - RNA, 1932 nt, Artificial Sequence
  derived and/or modified CDS sequence (opt4) from CCHFV(IbAr10200)__AF467768.2__Gc
uuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacaggugggcgaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggc

SEQ ID NO: 9103 - RNA, 1932 nt, Artificial Sequence
  derived and/or modified CDS sequence (opt4) from CCHFV(Turkey-Kelkit06)__GQ337054.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggugcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggagccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggcccugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcggcaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggc

SEQ ID NO: 9104 - RNA, 1935 nt, Artificial Sequence
  derived and/or modified CDS sequence (opt4) from CCHFV(SR3)__AJ538199.1__Gc
cuguuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcaacaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9105 - RNA, 1935 nt, Artificial Sequence
  derived and/or modified CDS sequence (opt4) from CCHFV(UCCR4413)__KY484038.1__Gc
uuccugagcagcaucgugaagggcaagaagaaccugcugaacagcgccagccuggagaccagccugagcaucgaggcccccuggggcgccaucaacgcccagagcaccuucaagcccaccaucagcaccgccaacaucgcccugagcuggagcagcguggagcacagaggcaacaaggugcuggugagcggcagaagcgagagcaucaugaagcuggaggagagaaccggcaucagcuggaaccugggcguggaggacgccagcgagagcagaaugcugaccgugagcgugauggaccugagccagauguaccugcccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugcccagcgagaucgugacccugcaccccaagaucgaggagggcuucuucgaccugaugcacgugcagaaggugcugagcgccagcaccgugugcaagcugcagagcugcacccacggcguggccggcgaccugcagguguaccacgugggcaaccugcugaagggcgacaagaucaacggccacagcauccacaagaucgagccccaccugaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagagcuuccacuuccacagcaagagagugaccgcccacggcgacaccccccagcuggaccugaaggccagacccauguacggcgccggcgagaucaccgugcugguggagguggccgacauggagcugcacagcaagaacaucgagaucagcggccugaaguucgccagccugaccugcagcggcugcuacgccugcagcagcggcaucagcugcaaggugagaauccacguggacgagcccgacgagcuggccgugcacgugaagagcgacgaccuggacgugguggccgccagcagcagccugauggccagaaagaucgaguucggcaccgacagcaccuucaaggccuucagcagcaugcccaaggagagccugugcuucuacaucguggagagagacuucugcaagagcugcgccgccgaggacacccagaagugcgugaaggccaagcuggagcagccccagagcauccugaucgagcacaagggcaccaucaucggcaagcagaacgacaccugcagcaccaagaccagcugcuggcuggagagcuucaagagcuucuucuacggccugaagaacaugcugagcggcguguucggcagcgccaucaugggcauccugcuguuccuggcccccuucauccugcugauccuguucuucuucuucggcuggagaauccuguucugccugagaugcugcagaagaaccagaggccuguucaaguacaagcacaucaaggacgacgaggaggccggcuacaagaagaucaucgagaagcugaacaacaagaagggcggcaccagcaagcugcuggacggcgagagacuggccgacagaaagaucgccgagcuguucagcaccaaggcccacaucggc

SEQ ID NO: 9106 - RNA, 1932 nt, Artificial Sequence
  derived and/or modified CDS sequence (opt4) from CCHFV(66019)__AB069669.1__Gc
uucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcaacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 9107 - RNA, 1932 nt, Artificial Sequence
  derived and/or modified CDS sequence (opt4) from CCHFV(7001)__AB069670.1__Gc
uuccuggacaacaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 9108 - RNA, 1932 nt, Artificial Sequence
  derived and/or modified CDS sequence (opt4) from CCHFV(75024)__AB069671.1__Gc
uuccuggacagcaucgugagaggcaugaagaaccagcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaaccuguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9109 - RNA, 1932 nt, Artificial Sequence
  derived and/or modified CDS sequence (opt4) from CCHFV(7803)__AB069672.1__Gc
uuccuggacagcaucgugagaggcaugaagaacccccugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacaugaucgugaaguggaagguggaguacaucaagaccagaggcaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccaccugauccacaagaucgagccccaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggaguucacccccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9110 - RNA, 1932 nt, Artificial Sequence
  derived and/or modified CDS sequence (opt4) from CCHFV(79121)__AB069673.1__Gc
uuccuggacagcaccgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagaucuaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaaccuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 9111 - RNA, 1932 nt, Artificial Sequence
  derived and/or modified CDS sequence (opt4) from CCHFV(8402)__AB069674.1__Gc
uucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9112 - RNA, 1932 nt, Artificial Sequence
  derived and/or modified CDS sequence (opt4) from CCHFV(88166)__AB069675.1__Gc
uucagcgacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgaccugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9113 - RNA, 1932 nt, Artificial Sequence
  derived and/or modified CDS sequence (opt4) from CCHFV(BA88166)__AF338470.1__Gc
uaccuggacagcaucgugaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcuggaaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaucaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9114 - RNA, 1932 nt, Artificial Sequence
  derived and/or modified CDS sequence (opt4) from CCHFV(BA66019)__AF350448.1__Gc
uucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgacagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaacagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgccaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagauaccugaaggacgacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 9115 - RNA, 1932 nt, Artificial Sequence
  derived and/or modified CDS sequence (opt4) from CCHFV(BA8402)__AF350449.1__Gc
uucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucaucaaguggaagguggaguacaucaagaccgaggccaucgugugcguggagcugaccagccaggagagacagugcacccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccugcacuacuacugcaacaugggcgacuggcccagcugcaccuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcgagagcugcagcaaggaggacacccagaagugcgugaacaccaagcuggagcagccccagagcauccugaucgagcacaagggcaccaucaucggcaagcagagcaacaccugcaccgccaaggccagcugcuggcuggagagcgugaagagcuucuucuacggccugaagaacaugcugagcggcaucuucggcaacguguucaucggcguguuccuguucuucgcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9116 - RNA, 1932 nt, Artificial Sequence
  derived and/or modified CDS sequence (opt4) from CCHFV(Matin)__AF467769.2__Gc
uuccuggacagcaucaucaagggcaugaagaaccugcugaacagcaccagccuggagaccagccugagcaucgaggcccccuggggcgccaucaacgugcagagcaccuucaagcccaccaugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggugaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugagcaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucgcccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacgugggc

SEQ ID NO: 9117 - RNA, 1932 nt, Artificial Sequence
  derived and/or modified CDS sequence (opt4) from CCHFV(Baghdad 12)__AJ538197.2__Gc
uuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgacgccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggugagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacuucuucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9118 - RNA, 1932 nt, Artificial Sequence
  derived and/or modified CDS sequence (opt4) from CCHFV(VLG/TI29414)__AY179961.1__Gc
uuccuggacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcugggaggugggcaccggcugcaccugcugcggcuggaacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcaugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugaucgccgccagcaccagccugauggccagaaagcuggaguucggcaccgacagcaccuucaaggccuucagcgccaugcccaagaccagccugugcuucuacaucgccgagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9119 - RNA, 1932 nt, Artificial Sequence
  derived and/or modified CDS sequence (opt4) from CCHFV(TADJ/HU8966)__AY179962.1__Gc
uuccuggacagcaucgugaagggcaugaagaacccccugaacagcaccagccuggagaccagccugagcaucgaggcccccuggggcgccaucaacgugcagagcaccuacaagcccaccgugagcaccgccaacaucgcccugagcuggagcagcaucgagcacagaggcaacaacauccuggugagcggcagaagcgagagcaucaugaagcuggaggagagaaccggcaucagcggcgaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaucgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggagaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacagaaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccugagcugcuucaagugcugcagaagaaccagaggccugcugaagcacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9120 - RNA, 1932 nt, Artificial Sequence
  derived and/or modified CDS sequence (opt4) from CCHFV(Hodzha)__AY223476.1__Gc
uuccuggacagcaucgugaagggcaccaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagagaaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9121 - RNA, 1932 nt, Artificial Sequence
  derived and/or modified CDS sequence (opt4) from CCHFV(Kosovo/9553/2001)__AY675511.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcccaacgacaccugccccgccaagaccagcugcuggcuggagagcgugaagagcuucuucuacggccugaagaacaugcugggcagcguguucggcaacuucuucaucggcauccugcuguuccuggcccccuucuuccuguggaugcugagcuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9122 - RNA, 1932 nt, Artificial Sequence
  derived and/or modified CDS sequence (opt4) from CCHFV(SPU41/84)__AY900142.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccuggugcacaagaucgagccccacuucaacaccagcuggaugagcugggacggcugcgaccuggacuacuacugcaacaugggcgacuggcccagcugcaccuacaccggcgugacccagcacaaccacgccagcuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucaccagccugaccugcaccggcugcuacgccugcagcagcggcaucagcugcaaggugagaauccacguggacgagcccgacgagcugaccgugcacgugaagagcgaggaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagagaaagggcaccaucaucggcaagcagaacaacaccugcaaggccaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaagaaucgccgagcuguucagcaccaagacccacaucggc

SEQ ID NO: 9123 - RNA, 1932 nt, Artificial Sequence
  derived and/or modified CDS sequence (opt4) from CCHFV(UG3010)__AY900143.1__Gc
uaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccaggagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacauccagcagagacugcccagcgagaucgugacccugcaccccaagaucgaggagggcuucuucgaccugaugcacgugcagaaggugcugagcgccagcaccgugugcaagcugcagagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcagcgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccaacgacgacacccagaagugcguggacaccaagcuggagcacccccagagcauccugaucgagcacaagggcaccaucaucggcaagcagaacgacaccugcagcaccaagaccagcugcuggcuggagagcgugaagagcuucuucuacggccugaagaacaugcugggcggcaucuucggcaacguguuccugggcaucuuccuguuccuggcccccuucgcccugcugaucuucuucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggc

SEQ ID NO: 9124 - RNA, 1932 nt, Artificial Sequence
  derived and/or modified CDS sequence (opt4) from CCHFV(Hy13)__AY900145.1__Gc
uucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9125 - RNA, 1932 nt, Artificial Sequence
  derived and/or modified CDS sequence (opt4) from CCHFV(Semunya)__DQ094832.1__Gc
uuccuggacagcaucgccaagggcaagaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacgugcagcagagacugcccagcgagaucgugacccugcaccccaagaucgaggagggcuucuucgaccugaugcacgugcagaaggugcuguucugcaaguacagccugcaggccaccagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucgugaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgaguucggcgccgacagcaccuucaaggccuucagcagcaugcccaagaacagccugugcuucuacaucguggagagagacuacugcagcagcugcaccgacgacgacacccagaagugcgugaacaucaagcuggagcacccccagagcauccugaucgagcacaagggcaccaucaucggcaagcagaacgacaccugccccaccaagaccagcugcuggcuggagagcgugaagagcuucuucuacggccugaagaacaugcugggcggcaucuucggcaacguguuccugggcaucuuccuguuccuggcccccuucgcccugcugauccuguucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccaagcuguucagcaccaagacccacaucggc

SEQ ID NO: 9126 - RNA, 1932 nt, Artificial Sequence
  derived and/or modified CDS sequence (opt4) from CCHFV(SPU128/81/7)__DQ157174.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaucggcaucuuccuguuccugggccccuucauccugcugauccuguucuucauguucggcuggagaauccuguucugcuucaagugcugcagaagaaccagaggccugcugaaguacagacaccugaaggaggacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9127 - RNA, 1932 nt, Artificial Sequence
  derived and/or modified CDS sequence (opt4) from CCHFV(ROS/HUVLV-100)__DQ206448.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9128 - RNA, 1932 nt, Artificial Sequence
  derived and/or modified CDS sequence (opt4) from CCHFV(AP92)__DQ211625.1__Gc
uuccuggacagcaucgccaagggcgugaagaaccugcugaacagcaccagccuggagaccagccugagcaucgaggcccccuggggcgccaucaacgcccagagcaccuacaagcccaccgccagcagcgccaacaucgcccugaccuggagcagcguggagcacagaggcaacaagauccuggugagcggcagaagcgagagcaucaugaagcuggaggagagaaccggcaucagcuggaaccugggcguggaggacgccagcgagagcagaacccugaccaucagcgugauggaccugagccagauguacagccccguguucgaguaccugagcggcgacagacagguggaggaguggcccaaggccaccugcaccggcaacugccccgagagaugcggcugcaccagcagcaccugccuguacaaggaguggccccacagcagaaacuggagaugcaaccccaccuggugcuggggcgugggcaccggcugcaccugcugcggccuggacgugaaggagcuguucaccgaccacaugcuggugaaguggaagguggaguacaucaagaccgaggccaucgugugcguggagcugaccagccaggagagacagugcagccugaucgaggccggcaccagauucagccugggccccgugaccaucacccugagcgagcccagaaacauccagcagaagcugccccccgagcugaucacccugcaccccaagaucgaggacggcuacuucgaccugaugcacgugcagaaggugaugagcgccagcaccgugugcaagcugcagagcugcacccacggcgugcccggcgaccugcagaucuaccacgugggcaaccugcugaagggcgacagagugaacggccaccugauccacaagguggagccccaccugaacaccagcuggaugagcugggacggcugcgaccuggacuacuucugcaacaugggcgacuggcccagcugcaccuacaccggcgugacccagcacaaccacgccgccuucgccaaccugcugaacaucgagaccgacuacaccaagaccuuccacuuccacagcaagagagugaccgcccacggcgacaccccccagcuggaccugaaggccagacccagauacggcgccggcgagaucaccgugcugguggagguggccgacauggagcugcacaccaagaagguggaggugaccggccugaaguucgccagccugaccugcagcggcugcuacgccugcagcagcggcaucagcugcaaggugagaauccacguggacgagcccgacgagcugaccgugcacgugaagagcagcgaccccgacaucguggccgccagcagcagccugauggccagaaagaucgaguucggcguggacagcaccuucaaggccuucagcagcaugcccaaggacagccugugcuucuacaucguggagagagacuacugcaacagcugcaagaacgaggagacccagagaugcgugaacgccaagcuggagcagccccagagcauccugaucgagcacaccggcaccaucaucggcaagcagaacgacaccugcggcagcagaaccagcugcuggcuggacagcuucaagagcuucuucuacggccugaagagcaugcugagcggcaucuucggcaacguguuccugggcaucuuccuguuccuggcccccuucgcccugcugcuguucuucuucuucuucggcuggagaauccuguucugcuucaagugcugcagaagaaccagaggccuguucaaguacagacacaucaaggacgacgaggaggugggcuacaagaagaucaucgagagacugaacaacaagaagggcaagcacagacugcuggacggcgagagacuggccgacagaaagaucgccgagcuguucagcaccaagacccacaucggc

SEQ ID NO: 9129 - RNA, 1932 nt, Artificial Sequence
  derived and/or modified CDS sequence (opt4) from CCHFV(ArD8194)__DQ211626.1__Gc
uuccuggacagaaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacaagggcaacaagauccuggugagcggcagaagcgagagcaucaugaagcuggaggagagaaccggcaucagcuggugccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacaugcuggugaaguggaagguggaguacaucaagaccgaggccaucaucugcguggagcugaccagccaggagagacagugcagccugaucgaggccggcaccagauucaaccugggccccgugaccaucacccugagcgagcccagaaacgugcagcagagacugccccccgagaucaucacccugcaccccaagaucgaggagggcuucuucgaccugaugcacgugcagaaggugaugagcgccagcaccgugugcaagcugcagagcugcacccacggcgugcccggcgaccugcagguguaccacgugggcaaccugcugaagggcgacaaggugaacggccacagcauccacaagaucgagagccaccugaacaccagcuggaugagcugggacggcugcgaccuggacuacuucugcaacaugggcgacuggcccagcugcaccuacaccggcgugacccagcacaaccacgccgccuucaucaacaugcugaacaucgagaccgacuacaccaagaccuuccacuuccacagcaagagagugaccgcccacggcgacaccccccagcuggaccugaaggccagacccgccuacggcgccggcgagaucaccgugcugguggagguggccgaccuggagcugcacaccaagaagaucgaggugagcggccugaaguucgccagccugagcugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagagcggcgccgacagcaccuucaaggccuucagcagcaugcccaagaacagccugugcuucuacaucguggagagagacuacugcagcagcugcaccgacgacgacacccagaagugcguggacaucaagcuggagcacccccagagcauccugaucgagcacaagggcaccaucaucggcaagcagaacgacaccugccccaccaagaccagcugcuggcuggagagcaucaagagcuucuucuacggccugaagaacaugcugagcggcaucuucggcaacguguuccugggcaugcugcuguuccuggcccccuucauccugcugauccuguucuucuucuucggcuggagacugcuguucugccugaagugcugcagaagaaccagaaagcugcugaaguacaagcaccugagagacgaggaggagagcggcuacaagaagaucaucgagagacugaacgacaagaagggcaagagcagacuguucgacggcgagagacuggccgacagaaagaucgccgagcuguucagcaccaagacccacaucggc

SEQ ID NO: 9130 - RNA, 1932 nt, Artificial Sequence
  derived and/or modified CDS sequence (opt4) from CCHFV(ArD15786)__DQ211627.1__Gc
agccuggacagcaucgccaagggcaugaagagccugcugaacagcaccagccuggagaccagccugagcaucgaggcccccuggggcgccaucaacgugcagagcaccuucaagcccaccaucagcgccgccaacaucgcccugagcuggagcagcguggagcacaagggcaacaagauccuggugagcggcagaagcgagagcaucaugaagcuggaggagagaaccggcaucagcuggugccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacaugcuggugaaguggaagguggaguacaucaagaccgaggccaucaucugcguggagcugaccagccaggagagacagugcagccugaucgaggccggcaccagauucaaccugggccccgugaccaucacccugagcgagcccagaaacgugcagcagagacugccccccgagaucaucacccugcaccccaagaucgaggagggcuucuucgaccugaugcacgugcagaaggugaugagcgccagcaccgugugcaagcugcagagcugcacccacggcgugcccggcgaccugcagguguaccacgugggcaaccugcugaagggcgacaaggugaacggccacagcauccacaagaucgagagccaccugaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagagcggcgccgacagcaccuucaaggccuucagcagcaugcccaagaacagccugugcuucuacaucguggagagagacuacugcagcagcugcaccgacgacgacacccagaagugcguggacaucaagcuggagcacccccagagcauccugaucgagcacaagggcaccaucaucggcaagcagaacgacaccugccccaccaagaccagcugcuggcuggagagcaucaagagcuucuucuacggccugaagaacaugcugagcggcaucuucggcaacaucuuccugggcaugcugcuguuccuggcccccuucgugcugcugauccuguucuucuucuucggcuggagacugcuguucugccugaagugcugcagaagaaccagaaagcugcugaaguacaagcaccugagagacgaggaggagagcggcuacaagaagaucaucgagagacugaacgacaagaagggcaagagcagacuguucgacggcgagagacuggccgacagaaagaucgccgagcuguucagcaccaagacccacgugggc

SEQ ID NO: 9131 - RNA, 1932 nt, Artificial Sequence
  derived and/or modified CDS sequence (opt4) from CCHFV(ArD39554)__DQ211628.1__Gc
uuccuggacagcaccgccaagagcaugaagagccugcugaacagcaccagccuggagaccagccugagcaucgaggcccccuggggcgccaucaacgugcagagcaccuucaagcccaccgccagcaccgccaacaucgcccugagcuggagcagcguggagcacagaggcaacaagauccuggugaccggcagaagcgagagcaucaugaagcuggaggagagaaccggcaucagcuggaaccugggcguggaggacgccagcgagagcaagacccugaccgugagcgugauggaccugagccagauguacagcaccguguucgaguaccugagcggcgacagacagguggaggaguggcccaaggccaccugcaccggcgacugccccgagagaugcggcugcaccagcagcaccugccugcacaaggccuggccccacagcagaaacuggagaugcaaccccaccuggugcuggggcgugggcaccggcugcaccugcugcggccuggacgugaagaaccuguucaccgacuacaugcugaucaaguggaagguggaguucaucaagaccgaggccaucgugugcguggagcugaccagccaggagagacagugcagccugaucgaggccggcaccagauucaaccugggccccgugaccaucacccugagcgagcccagaaacauccagcagaagcugccccccgagcuggugacccugcaccccagaguggaggagggcuucuucgaccugaugcacgugcagaaggugcugagcgccagcaccgugugcaagcugcagagcugcacccacggcgugcccggcgaccugcagguguaccacgugggcaaccugcugaagggcgacaagaucaacggcaacagcuuccacaagaucgagcccaaccugaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgagaccccccagcuggaccugaaggccagacccaaguacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagacugcacguggacgagcccgacgagcugaccgugcacgugaagagcgacgaccccgacgugguggccgccagcagcagccugauggccagaaagaucgaguucggcaccgacagcaccuucaaggccuucagcagcaugcccaaggacaagcugugcuucuacaucguggagagagacuacugcagcagcugcagcaaggaggacacccagaagugcgugaacgccaagcuggagcagccccagagcauccugaucgagcacaagggcaccaucaucggcaagcagaacgacaccugcaccgugaaggccagcugcuggcuggagagcgugaagagcuucuucuacggccugaagaacaugcugggcggcaucuucggcaacgugauccugggcaucaucauguuccuggcccccuucgcccugcugcugcuguucuuccuguucggcuggagaauccuguucugccugagaugcugcagaagaaccagaggccuguucaaguacaagcacaucaaggacgacgaggagagcggcuacaagagaaucaucgagagacugaacaacaagaagggcaagaacaagcuguucgacggcgagagacuggccgacaagaagaucgccgagcuguucagcaccaagacccacaucggc

SEQ ID NO: 9132 - RNA, 1932 nt, Artificial Sequence
  derived and/or modified CDS sequence (opt4) from CCHFV(C-68031)__DQ211629.1__Gc
uucagcgacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugaagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaucuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccagcaaggccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9133 - RNA, 1932 nt, Artificial Sequence
  derived and/or modified CDS sequence (opt4) from CCHFV(Drosdov)__DQ211630.1__Gc
uuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaugaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9134 - RNA, 1932 nt, Artificial Sequence
  derived and/or modified CDS sequence (opt4) from CCHFV(Kashmanov)__DQ211631.1__Gc
uuccuggacagcaucgugaagggcaugaagaacagccugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9135 - RNA, 1932 nt, Artificial Sequence
  derived and/or modified CDS sequence (opt4) from CCHFV(Oman)__DQ211632.1__Gc
uuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9136 - RNA, 1932 nt, Artificial Sequence
  derived and/or modified CDS sequence (opt4) from CCHFV(SPU97/85)__DQ211633.1__Gc
uuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacacccagaagugcgugaacaccaagcuggagagaccccagagcauccugaucgagcacaagggcaccaucaucggcaagcagaacgacaccugcaccgccaaggccagcugcuggcuggagagcgugaagagcuucuucuacggccugaagagcaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 9137 - RNA, 1932 nt, Artificial Sequence
  derived and/or modified CDS sequence (opt4) from CCHFV(SPU103/87)__DQ211634.1__Gc
uuccuggacaacaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagaucgaguacaucaagaccgaggccaucgugugcguggagcugaccagccaggagagacagugcagccugaucgaggccggcaccagauucaaccugggccccgugaccaucacccugagcgagcccagaaacauccagcagaagcugcccagcgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccuggugcacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucaccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagcacaagggcaccaucaucggcaagcagaacaacaccugcaaggccagagccggcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaagaaucgccgagcuguucagcaccaagacccacaucggc

SEQ ID NO: 9138 - RNA, 1932 nt, Artificial Sequence
  derived and/or modified CDS sequence (opt4) from CCHFV(SPU415/85)__DQ211635.1__Gc
uuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 9139 - RNA, 1932 nt, Artificial Sequence
  derived and/or modified CDS sequence (opt4) from CCHFV(Turkey200310849)__DQ211636.1__Gc
uuccuggacagcaucgugaagggcaugaagaaccugcugaacagcaccagccuggagaccagccugagcaucgaggcccccuggggcgccaucaacgugcagagcaccuucaagcccgccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggc

SEQ ID NO: 9140 - RNA, 1932 nt, Artificial Sequence
  derived and/or modified CDS sequence (opt4) from CCHFV(Iran-52)__DQ446215.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggaggagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9141 - RNA, 1932 nt, Artificial Sequence
  derived and/or modified CDS sequence (opt4) from CCHFV(Iran-53)__DQ446216.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9142 - RNA, 1932 nt, Artificial Sequence
  derived and/or modified CDS sequence (opt4) from CCHFV(Kosova Hoti)__EU037902.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugcccccagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagaaggaguacugcaagagcugcagcgaggacgacaccaagaagugcguggacaccaagcuggagcagccccagagcauccugaucgagcacagaggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9143 - RNA, 1932 nt, Artificial Sequence
  derived and/or modified CDS sequence (opt4) from CCHFV(YL04057)__FJ562094.1__Gc
uuccuggacagcaucgccaagggcaagaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcagccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcauccugcuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 9144 - RNA, 1932 nt, Artificial Sequence
  derived and/or modified CDS sequence (opt4) from CCHFV(V42/81)__GU477490.1__Gc
uuccuggacagcaucgugaagggcaagaagaaccugcugaacagcaccagccuggagaccagccugagcaucgaggcccccuggggcgccaucaacauccagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaucgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgagaccccccagcuggaccugaaggccagacccgccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggagagcggcaccgacagcaccuucaaggccuucagcgccaugcccaagaccagccugugcuucuacaucguggagagagaguacugcaagagcugcagcgaggacgacacccagaagugcguggagaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggaggacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9145 - RNA, 1932 nt, Artificial Sequence
  derived and/or modified CDS sequence (opt4) from CCHFV(79121M18)__GU477493.1__Gc
uuccuggacagcaccgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagaucuaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcuggagagcgugaagggcuucuucuacggccugaagaacaugcugagcggcaucuucggcaacguguuccugggcaucuuccuguuccuggcccccuucgugcugcugaucuucuucuucuucuucggcuggagacugcuguucugccugaagugcugcagaagaaccagaggccugcugaaguacaagcaccugaaggacgaggaggaggccggcuacaagaagaucaucgagagacugaacggcaagaagggcaagagccagcuguucgacggcgagagacuggccgacagaaagaucgccgagcuguucagcaccaagauccacaucggc

SEQ ID NO: 9146 - RNA, 1932 nt, Artificial Sequence
  derived and/or modified CDS sequence (opt4) from CCHFV(Afg09-2990)__HM452306.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9147 - RNA, 1932 nt, Artificial Sequence
  derived and/or modified CDS sequence (opt4) from CCHFV(Sudan Al-Fulah 3-2008)__HQ378184.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagaaggaguacugcaagagcugcagcgaggaggacaccaagaagugcgugaacaccaagcuggagcagccccagagcauccugaucgagcacaagggcaccaucaucggcaagcagaacagcaccugcaccgccaaggugagcugcuggcuggagagcgccaagagcuucuucuacggccugaaggacaugcugagcggcaucuucggcaacguguucaucggcaucuuccuguuccuggcccccuucgugcugcuggugcuguucuucauguucggcuggagaauccugcugugcuucagaugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaaagaucgccgagcuguucagcaccaagacccacaucggc

SEQ ID NO: 9148 - RNA, 1932 nt, Artificial Sequence
  derived and/or modified CDS sequence (opt4) from CCHFV(Sudan AB1-2009)__HQ378187.1__Gc
uuccuggacagcaucgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcaacgaggaggacaccaagaagugcgugaacaccaagcuggagcagccccagagcauccugaucgagcacaagggcaccaucaucggcaagcagaacagcaccugcaccgccagagccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9149 - RNA, 1932 nt, Artificial Sequence
  derived and/or modified CDS sequence (opt4) from CCHFV(NIVA 118595)__JN572083.1__Gc
uuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggagagcggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9150 - RNA, 1932 nt, Artificial Sequence
  derived and/or modified CDS sequence (opt4) from CCHFV(NIV 112143)__JN572085.1__Gc
uuccuggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcaccugaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugagcugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagggcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguuccugggcaucuucagcuuccuggcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9151 - RNA, 1932 nt, Artificial Sequence
  derived and/or modified CDS sequence (opt4) from CCHFV(SCT ex Afghanistan)__KC344856.1__Gc
uuccugaacagcaucgugaagggcaugaagaaccugcugaacagcaccaaccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagagccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaagcugaacggccacaugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgacaucagcggccugaaguucgccagccugaccugcgccggcugcuacgccugcagcagcggcaucagcugcaaggugagaauccacguggacgagcccgacgagcugaccgugcacgugaagagcgaggaccccgacaucguggccgccagcaccagccugaucgccagaaagcuggagcugggcaccgacagcaccuucaaggccuucagcgccaugcccaagaccagccugugcuucuacaucguggagagagaguacugcaagagcugcagcaaggaggacacccagaagugcgugaacaccaagcuggagcacccccagggcauccugaucgagcacaagggcaccaucaucggcaagcagaacgacaccugcaccgccaaggccggcugcuggcuggagagcgugaagagcuucuucuacggccugaagaacaugcugagcggcaucuucggcaacguguucaucggcaucuuccuguuccuggcccccuucgugcugcugauccuguucuucauguucggcuggagacugcuguucugcuucaagugcugcagaagaaccagaggccuguucaaguacagacaccugaaggaggacgaggagagcggcuacagaagaaucaucgagagacugaacaacaagaagggcaagaacaagcugcuggacggcgagagacuggccgacagaagaaucgccgagcuguucagcaccaagacccacaucggc

SEQ ID NO: 9152 - RNA, 1932 nt, Artificial Sequence
  derived and/or modified CDS sequence (opt4) from CCHFV(Zahedan 2007)__KC867273.1__Gc
uuccuggacagcaucgugaaggacaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugaucuucuucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9153 - RNA, 1932 nt, Artificial Sequence
  derived and/or modified CDS sequence (opt4) from CCHFV(SPU 44/08)__KJ682805.1__Gc
uuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 9154 - RNA, 1932 nt, Artificial Sequence
  derived and/or modified CDS sequence (opt4) from CCHFV(SPU 383/87)__KJ682806.1__Gc
uuccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucuucggcaagcagaacgacaccugcaccgccaaggccagcugcuggcuggagagcgugaagagcuucuucuacggccugaagaacaugcugagcggcaucuucggcaacguguucaucggcguguuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 9155 - RNA, 1932 nt, Artificial Sequence
  derived and/or modified CDS sequence (opt4) from CCHFV(SPU 130/89)__KJ682807.1__Gc
agccuggacagcaucgugaagggcaugaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagagcacugcaagagcugcagcaaggaggacacccagagaugcgugaacaccaagcuggagcagccccagagcauccugaucgagcacaagggcaccaucaucggcaagcagaacgacaccugcaccgccaaggccagcugcuggcuggagagcaucaagagcuucuucuacggccugaagaacaugcugagcggcaucuucggcaacguguucaucggcguguuccuguuccuggcccccuucaucauccugauccuguucuucauguucggcuggagaauccuguucugcuucaagugcugcagaagaaccagaggccugcugaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 9156 - RNA, 1932 nt, Artificial Sequence
  derived and/or modified CDS sequence (opt4) from CCHFV(SPU 497/88)__KJ682808.1__Gc
uuccuggacagcaucgugaagggcaugagaaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccagagccagcugcuggcuggagagcaucaagagcuucuucuacggccugaagaacaugcugagcggcaucuucggcaacguguucaucggcaucuuccuguucuucgcccccuucaucaugcugauccuguucuucauguucggcuggagaauccuguucugcuucaagugcugcagaagaaccagaggccuguucaaguacagacaccugaaggacgacgaggaggugggcuacagaaagaucaucgagagacugaacaacaagaagggcaagaacaagcugcuggacggcgagagacuggccgacagaaagaucgccgagcuguucagcaccaagacccacaucggc

SEQ ID NO: 9157 - RNA, 1932 nt, Artificial Sequence
  derived and/or modified CDS sequence (opt4) from CCHFV(SPU 18/88)__KJ682810.1__Gc
uuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacauccagaaggugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccggcaaggccggcugcuggcuggagagcaucaagagcuucuucuacggccugaagaacaugcugagcggcaucuucggcaacguguucaucggcaucuuccuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaagaacaagaagggcaagaacaagcugcuggacggcgagagacuggccgacagaaagaucgccgagcuguucagcaccaagacccacaucggc

SEQ ID NO: 9158 - RNA, 1932 nt, Artificial Sequence
  derived and/or modified CDS sequence (opt4) from CCHFV(SPU 431/85)__KJ682812.1__Gc
uuccuggacagcaucgugaagggcagaaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagagagugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgaggugaccgugcugguggagguggccgacauggagcugcacaccaagaagaucgagaucagcggccugaaguucgccagccugaccugcaccggcugcuacgccugcagcagcggcaucagcugcaaggugaagauccacguggacgagcccgacgagcugaccgugcacgugaagagcgaggaccccgacaucguggccgccggcagcagccugauggccagaaagcuggaguucggcgccgacagcaccuucaaggccuucagcgccaugcccaagaccagccugugcuucuacaucguggagagagaguacugcaagagcugcagcagagaggacaccagaaagugcgugaacaccaagcuggacagaccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucaucggcaucuuccuguucaucgcccccuucgugcugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagagccacaucggc

SEQ ID NO: 9159 - RNA, 1932 nt, Artificial Sequence
  derived and/or modified CDS sequence (opt4) from CCHFV(SPU 48/90)__KJ682813.1__Gc
uucagagacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaacagagccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagaaggaguacugcaagagcugcagcgaggaggacaccaagaagugcgugaacaccaagcuggagcagccccagagcauccugaucgagcacaagggcaccaucaucggcaagcagaacagcaccugcaccgccaaggugagcugcuggcuggagagcgccaagagcuucuucuacggccugaaggacaugcugagcggcaucuucggcaacguguucaucggcaucuuccuguuccuggcccccuucauccugcugauccuguucuucauguucggcuggagaauccugcugugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9160 - RNA, 1932 nt, Artificial Sequence
  derived and/or modified CDS sequence (opt4) from CCHFV(SPU 187/90)__KJ682814.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaucuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaagaccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9161 - RNA, 1932 nt, Artificial Sequence
  derived and/or modified CDS sequence (opt4) from CCHFV(Haskovo-V46/13)__KR092379.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccggcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccaagcuggagcagccccagagcauccugaucgagcacaagggcaccaucaucggcaagcagaacgacaccugcaccgccagagccagcugcuggcuggagagcgugaagagcuucuucuacggccugaagaacaugcugggcagcguguucggcaacuuccugaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9162 - RNA, 1932 nt, Artificial Sequence
  derived and/or modified CDS sequence (opt4) from CCHFV(24-R-2012)__KR814856.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9163 - RNA, 1932 nt, Artificial Sequence
  derived and/or modified CDS sequence (opt4) from CCHFV(36-ST-2014)__KR814857.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaaguuccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggc

SEQ ID NO: 9164 - RNA, 1932 nt, Artificial Sequence
  derived and/or modified CDS sequence (opt4) from CCHFV(37-R-2013)__KR814858.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgugaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9165 - RNA, 1932 nt, Artificial Sequence
  derived and/or modified CDS sequence (opt4) from CCHFV(44-ST-2010)__KR814859.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggaccagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaugugcggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagagccacaucggc

SEQ ID NO: 9166 - RNA, 1932 nt, Artificial Sequence
  derived and/or modified CDS sequence (opt4) from CCHFV(46-ST-2012)__KR814860.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccagacuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9167 - RNA, 1932 nt, Artificial Sequence
  derived and/or modified CDS sequence (opt4) from CCHFV(47-ST-2013)__KR814861.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgagugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9168 - RNA, 1932 nt, Artificial Sequence
  derived and/or modified CDS sequence (opt4) from CCHFV(52-R-2014)__KR814862.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggacgacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcaacgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccggcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9169 - RNA, 1932 nt, Artificial Sequence
  derived and/or modified CDS sequence (opt4) from CCHFV(75-R-2012)__KR814863.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuuccuguacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacugcugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9170 - RNA, 1932 nt, Artificial Sequence
  derived and/or modified CDS sequence (opt4) from CCHFV(75-ST-2010)__KR814864.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9171 - RNA, 1932 nt, Artificial Sequence
  derived and/or modified CDS sequence (opt4) from CCHFV(3756-ST-2007)__KR814866.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccugacccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9172 - RNA, 1932 nt, Artificial Sequence
  derived and/or modified CDS sequence (opt4) from CCHFV(3809-ST-2007)__KR814867.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcagaagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccugacccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9173 - RNA, 1932 nt, Artificial Sequence
  derived and/or modified CDS sequence (opt4) from CCHFV(3820-ST-2007)__KR814868.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9174 - RNA, 1932 nt, Artificial Sequence
  derived and/or modified CDS sequence (opt4) from CCHFV(4495-ST-2008)__KR814869.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcaucagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagagaugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagagccagaggccugcugaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9175 - RNA, 1932 nt, Artificial Sequence
  derived and/or modified CDS sequence (opt4) from CCHFV(4691-ST-2009)__KR814871.1__Gc
uuccuggacagcaucgugaagggcaugaagaaccugcugaacagcaccagccuggagaccagccugagcaucgaggcccccuggggcgccaucaacgugcagagcaccuucaagcccgccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9176 - RNA, 1932 nt, Artificial Sequence
  derived and/or modified CDS sequence (opt4) from CCHFV(4701-ST-2009)__KR814872.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcggcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9177 - RNA, 1932 nt, Artificial Sequence
  derived and/or modified CDS sequence (opt4) from CCHFV(Oman-199809166)__KR864901.1__Gc
uuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9178 - RNA, 1932 nt, Artificial Sequence
  derived and/or modified CDS sequence (opt4) from CCHFV(200406546-Turkey)__KR864902.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugaccgccagaaagcuggaguucggcaccgacagcaccuucaaggccuucagcgccaugcccaagaccagccugugcuucuacaucguggagaaggaguacugcaagagcugcaacgaggacgacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacaagagaaucaucgagagacugaacaacaagaagggcaagaacagacugcuggacggcgagagacuggccgacagaaagaucgccgagcuguucagcaccaagacccacaucggc

SEQ ID NO: 9179 - RNA, 1932 nt, Artificial Sequence
  derived and/or modified CDS sequence (opt4) from CCHFV(1-CR/HU-2015)__KU161584.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9180 - RNA, 1932 nt, Artificial Sequence
  derived and/or modified CDS sequence (opt4) from CCHFV(Gaib)__KX013445.1__Gc
uucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcaucgagcacagaggcaacaagauccuggugagcggcagaagcgagagcaucaugaagcuggaggagagaaccggcaucagcugggaccugggcguggaggacgccagcgagagcagacugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcagagaggacacccagaagugcgugagcaccaagcuggagcagccccagagcauccugaucgagcacaagggcaccaucaucggcaagcagaacaacaccugcaccaccaagaccaccugcuggcuggagagcgugaagagcuucuucuacggccugaagaacaugcugagcagcaucuucggcaacguguucgugggcaucuucagcuuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagagcaagcugcuggacggcgagagacuggccgacagaaagaucgccgagcuguucagcaccaagacccacaucggc

SEQ ID NO: 9181 - RNA, 1932 nt, Artificial Sequence
  derived and/or modified CDS sequence (opt4) from CCHFV(Hodzha)__KX013448.1__Gc
uuccuggacagcaucgugaagggcaagaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugcagcgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugguggaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucaccggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcagaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucaaguacaagcaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9182 - RNA, 1932 nt, Artificial Sequence
  derived and/or modified CDS sequence (opt4) from CCHFV(IbAn7620)__KX013451.1__Gc
uuccuggacagcaucgccaagggcaugaagaacccccugaacagcaccagccuggagaccagccugagcaucgaggcccccuggggcgccaucgacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccaacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9183 - RNA, 1932 nt, Artificial Sequence
  derived and/or modified CDS sequence (opt4) from CCHFV(K128_76)__KX013454.1__Gc
uuccaggacagcaucgugaagggcaugaagaaccugcugaacagcaccagccuggagaccagccugagcaucgaggcccccuggggcgccaucaacgugcagagcaccuacaagcccgccgugagcgccgccaacaucgcccugagcuggagcagcguggagcacagaggcagcaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggagaacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9184 - RNA, 1932 nt, Artificial Sequence
  derived and/or modified CDS sequence (opt4) from CCHFV(K168_40)__KX013457.1__Gc
uuccuggacggcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9185 - RNA, 1932 nt, Artificial Sequence
  derived and/or modified CDS sequence (opt4) from CCHFV(K168_125)__KX013460.1__Gc
uuccuggacagcaucgugaagggcaagaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucaucaaccugcugaacaucgagaccgacuacaccaagagcuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcacccccagagcauccugaucgagcacaagggcaccaucaucggcaagcagaacaacaccugcaccgccaagaccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9186 - RNA, 1932 nt, Artificial Sequence
  derived and/or modified CDS sequence (opt4) from CCHFV(K229_194)__KX013463.1__Gc
uuccuggacagcaucgugaagggcaagaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacagcugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 9187 - RNA, 1932 nt, Artificial Sequence
  derived and/or modified CDS sequence (opt4) from CCHFV(K229_243)__KX013466.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagaaggaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccugacccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9188 - RNA, 1932 nt, Artificial Sequence
  derived and/or modified CDS sequence (opt4) from CCHFV(K315_14)__KX013469.1__Gc
uuccuggacagcaucgugaagggcaugaagaagcugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9189 - RNA, 1932 nt, Artificial Sequence
  derived and/or modified CDS sequence (opt4) from CCHFV(K323_27)__KX013472.1__Gc
uuccuggacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccggccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaacgacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9190 - RNA, 1932 nt, Artificial Sequence
  derived and/or modified CDS sequence (opt4) from CCHFV(K340_6)__KX013475.1__Gc
agccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggaggugaccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacacuucaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9191 - RNA, 1932 nt, Artificial Sequence
  derived and/or modified CDS sequence (opt4) from CCHFV(Mamon)__KX013478.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaagaccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9192 - RNA, 1932 nt, Artificial Sequence
  derived and/or modified CDS sequence (opt4) from CCHFV(Min)__KX013481.1__Gc
uuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagaaucaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9193 - RNA, 1932 nt, Artificial Sequence
  derived and/or modified CDS sequence (opt4) from CCHFV(Nakiwogo)__KX013484.1__Gc
uaccuggacagcaucgccaagggcaugaagagccugcugaacagcaccaaccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcuggagccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugagagaccuguucaccgacuacaugauggugaaguggaagguggaguacgugaagaccgaggccaucaugugcguggagcugaccagccaggagagacagugcagccugaucgaggccggcaccagauucaaccugggccccgugaccaucacccugagcgagcccagaaacgugcagcagagacugcccagcgagaucgugacccugcaccccaagaucgaggagggcuucuucgaccugaugcacgugcagaaggugcuguucugcaagcacagccugcaggccaccagcugcacccacggcgugcccggcgaccugcagguguaccacgugggcaaccugcugaagggcgacaaggugaacggccacagcauccacaagaucgagagccacuucaacaccagcuggaugagcugggacggcugcgaccuggacuacuucugcaacaugggcgacuggcccagcugcaccuacaccggcgugacccagcacaacagagccgccuucgugaacaugcugaacaucgagaccgacuacaccaagaccuuccacuuccacagcaagagagugaccgcccacggcgacaccccccagcuggaccugaaggccagacccaccuacggcgccggcgaggugaccgugcugguggagguggccgaccuggagcugcacaccaagaagaucgaggugagcggccugaaguucgccagccugaccugcagcggcugcuacgccugcagcagcggcaucagcugcaaggugagaauccacgugaacgagcccgacgaguucaccgugcacgugaagagcaacgaccccgacgugguggccgccggcagcagccugauggccagaaagaucgagcugggcgccgacagcaccuucaaggccuucagcagcaugcccaagaacagccugugcuucuacaucguggagagagacuacugcagcagcugcaccgacgacgacacccagaagugcgugaacaccaagcuggagcacccccagagcauccugaucgagcacaagggcaccaucaucggcaagcagaacgacaccugccccaccaagaccagcugcuggcuggagagcgugaagagcuucuucuacggccugaagaacaugcugggcggcaucuucggcaacguguuccugggcaucuuccuguuccuggcccccuucgcccugcugauccuguucuucuucuucggcuggagacugcuguucugccugaagugcugcagaagaaccagaggccugcugaaguacaagcagcugaaggacgaggaggaggccggcuacaagaagaucaucgagagacugaacgacaagaagggcaagagcagacuguucgacggcgagagacuggccgacagaaagaucgccgagcuguucagcaccaagacccacaucggc

SEQ ID NO: 9194 - RNA, 1932 nt, Artificial Sequence
  derived and/or modified CDS sequence (opt4) from CCHFV(Saf)__KX013487.1__Gc
uucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagguggaggagggcuucuucgaccugaugcacgugcagaaggugcugagcgccagcaccgugugcaagcugcagagcugcacccacggcauccccggcgaccugcagguguaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaugaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgugagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggaggacacccagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucaucggcauccugcuguuccuggcccccuucgugcugcuggugcuguucuucauguucggcuggaagauccuguucugcuucaagugcugcagaagaaccagaggccugcugaaguacagacaccugaaggacgacgaggagaccggcuacagaagaaucaucgagagacugaacaacaagaagggcaagaacagacugcuggacggcgagagacuggccgacagaaagaucgccgagcuguucagcaccaagacccacaucggc

SEQ ID NO: 9195 - RNA, 1932 nt, Artificial Sequence
  derived and/or modified CDS sequence (opt4) from CCHFV(Ast199)__KX056051.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 9196 - RNA, 1932 nt, Artificial Sequence
  derived and/or modified CDS sequence (opt4) from CCHFV(Ast149)__KX056054.1__Gc
uuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggcccuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 9197 - RNA, 1932 nt, Artificial Sequence
  derived and/or modified CDS sequence (opt4) from CCHFV(Ast137)__KX056057.1__Gc
uuccuggacagcaucgugaagggcaccaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagacugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggaggugagcggccugaaguucgccagccuggccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucaucuucggcuggaagauccuguucugcuucaagugcugcagaagaaccagaggccuguucaaguacagacaccugaaggacgacgaggagaccggcuacagaaagaucaucgagagacugaacagcaagaagggcaagaacagacugcuggacggcgagagacuggccgacagaaagaucgccgagcuguucagcaccaagacccacaucggc

SEQ ID NO: 9198 - RNA, 1932 nt, Artificial Sequence
  derived and/or modified CDS sequence (opt4) from CCHFV(Ast133)__KX056060.1__Gc
uucagcgacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucaucaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccugaccugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcagcuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcagcaagacccacaucggc

SEQ ID NO: 9199 - RNA, 1932 nt, Artificial Sequence
  derived and/or modified CDS sequence (opt4) from CCHFV(SK/2015/human)__KX458183.1__Gc
uuccuggacagcaucgugagaggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcgugagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccaccagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccagggcagacagugcagccugaucgaggccggcaccagauucaaccugggcagcgugaccaucacccugagcgagcccagaaacauccagcacaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacagaggcaccaucaucggcaagcagaacaacaccugcaucgccaaggccagcugcuggcuggagagcgugaagagcuucuucuacggccugaagaacaugcugagcggcaucuucggcaaccuguuccugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9200 - RNA, 1932 nt, Artificial Sequence
  derived and/or modified CDS sequence (opt4) from CCHFV(YL16070)__KY354081.1__Gc
uuccuggacagcaucgccaagggcaugaagagccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcgugagcuggaaccugggcguggaggacgccagcgagagcaagacccugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggacuucuucaccgacuacaugcuggugaaguggaagguggaguacaucaagaccgaggccaucgugugcguggagcugaccagccaggagagacagugcagccugaucgaggccggcaccagauucaaccugggccccgugaccaucacccugagcgagcccagaaacgugcagcagagacugccccccgagaucgugacccugcaccccaagaucgaggagggcuucuucgaccugaugcacgugcagaagauccugagcgccagcaccgugugcaagcugcagagcugcacccacggcgugcccggcgacuuccagguguaccacgugggcaaccugcugagaggcgacaaggugaacggccacagcauccacaagaucgagccccacuucaacaccagcuggaugagcugggacggcugcgaccuggacuacuucugcaacaugggcgacuggcccagcugcaccuacaccggcgugacccagcacaacagagccgccuucaucaacaugcugaacaucgagaccgacuacaccaagaccuuccacuuccacagcaagagagugaccgcccacggcgacaccccccagcuggaccugaaggccagacccgccuacggcgccggcgaggugaccgugcugguggagguggccgaccuggagcugcacaccaagaagcuggaggugagcggccugaagaucgccagccugaccugcagcggcugcuacgccugcagcagcggcaucagcugcaaggugagaauccacgugaacgagcccgacgaguucaccgugcacgugagaagcagcgaccccgacgugguggccgccggcagcagccugauggccagaaagaucgaguucggcgccgacagcaccuucaaggccuucagcagcaugcccaaggacagccugugcuucuacaucguggagaaggacuacugcagcagcugcaccgacgacgacacccagaagugcgugaacaccaagcuggaccacccccagagcauccugaucgagcacaagggcaccaucaucggcaagcagaacgacaccugcagcaccaagaccagcugcuggcugaagagcuucaagggcuucuucuacggccugaagaacaugcugagcggcaucuucggcaacguguuccugggcauccugcuguuccuggcccccuucgugcugcugaucuucuucuucuucuucggcuggagacugcuguucugccugaagugcugcaagaagaccaagggccugcugaaguacaagcaccugaaggacaaggaggaggccggcuacaagaagaucaucgagagacugaacggcaagaagggcaagagccagcuguucgacggcgagagacuggccaacagaaagaucgccgagcuguucagcaccaagauccacaucggc

SEQ ID NO: 9201 - RNA, 1932 nt, Artificial Sequence
  derived and/or modified CDS sequence (opt4) from CCHFV(Oman_812956)__KY362518.1__Gc
uucuucgacagcaucgccaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagguggagccccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaacuuccacuuccacagcaagagagugaccgcccacggcgacaccccccagcuggaccugaaggccagacccaacuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacgccaagcuggagagaccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacaagcugcuggacggcgagagacuggccgacagaaagaucgccgagcuguucagcaccaagacccacaucggc

SEQ ID NO: 9202 - RNA, 1932 nt, Artificial Sequence
  derived and/or modified CDS sequence (opt4) from CCHFV(UCCR4405)__KY484029.1__Gc
uuccuggacagcaccgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggagcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggcguggacgugaaggaccuguucaccgaccacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcagaucuaccacaucggcaaccugcugaagggcgacagagugaacggccaccugauccacaagaucgagccccacuucaacaccagcuggaugagcugggacggcugcgaccuggacuacuacugcaacaugggcaacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagguggagaucagcggccugaaguucgccagccuggugugcaccggcugcuacgccugcagcagcggcaucagcugcaaggugagaauccacguggacgagcccgacgagcugaccgugcacgugaagagcagcgaccccgacgugguggccgccagcaccagccugauggccagaaagcuggaguucggcaccgacagcaucuucaaggccuucagcgccaugcccaagaccagccugugcuucuacaucguggagagagaguacugcaagagcugcagcgaggacgacaccaagaagugcguggacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugggcagcguguucggcaacuucuucgugggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgagagacuggccgacagaaagaucgccgagcuguucagcaccaagacccacaucggc

SEQ ID NO: 9203 - RNA, 1932 nt, Artificial Sequence
  derived and/or modified CDS sequence (opt4) from CCHFV(UCCR4401)__KY484035.1__Gc
uuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggc

SEQ ID NO: 9204 - RNA, 1932 nt, Artificial Sequence
  derived and/or modified CDS sequence (opt4) from CCHFV(UCCR4448)__KY484042.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagaagaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccugcaccgccaaggccagcugcuggcuggagagcgugaagagcuucuucuacggccugaagaacaugcugagcggcaucuucggcaacguguucaucggcaucuuccuguuccuggcccccuucauccugcugauccuguucuucauguucggcuggaagauccuguucugcuucaagugcugcagaagaaccagaggccuguucaaguacagacaccugaaggacgacgaggagaccggcuacagaagaaucaucgagagacugaacaacaagaagggcaagaacaagcugcuggacggcgagauccuggccgacagaagaaucgccgagcuguucagcaccaagacccacaucggc

SEQ ID NO: 9205 - RNA, 1932 nt, Artificial Sequence
  derived and/or modified CDS sequence (opt4) from CCHFV(U2-2-002/U-6415)__AY900144.1__Gc
uuccaggacagcaucgugaagggcaugaagaaccugcugaacagcaccagccuggagaccagccugagcaucgaggcccccuggggcgccaucaacgugcagagcaccuacaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagagcuuccacuuccacagcaagagagugaccgcccacggcgacaccccccagcuggaccugaaggccagacccagcuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgaguucaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcagcgaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugagcggcaucuucggcaacguguucgugggcaucuuccuguuccuggcccccuucauccugcugauccuguucuucauguucggcuggagaauccuguucugcuucaagugcugcagaagaaccagaggccuguucagauacaagcaccuggagaacgacgaggagaccggcuacagaagaaucaucgagagacugaacaacaagaagggcaagaacaagcugcuggacggcgagagacuggccgacagaagaaucgccgagcuguucagcaccaagacccacaucggc

SEQ ID NO: 9206 - RNA, 1932 nt, Artificial Sequence
  derived and/or modified CDS sequence (opt4) from CCHFV(SPU 45/88)__KJ682809.1__Gc
uuccuggacagcaucgugaagggcaagaagaaccugcugaacagcaccagccuggagaccagccugagcaucgaggcccccuggggcgccaucaacgugcagagcaccuucaagcccaccgugagcgccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggacuacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucgugacccugcaccccagaaucgaggagggcuucuucgaccugaugcacgugcagaacgugcugagcgccagcaccgugugcaagcugcagagcugcacccacggcgugcccggcgaccugcagaucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcagcuacaccggcgugacccagcacaaccacgccgccuucgugaacaugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccugaccugcaccggcugcuacgccugcagcagcggcaucagcugcaaggugagaauccacguggacgagcccgacgagcugaccgugcacgugaagagcgaggaccccgacaucguggccgccagcagcagccugauggccagaaagcuggaguucggcaccgacagcaccuucaaggccuucagcgccaugcccaagaccagccugugcuucuacaucguggagagagaguacugcaagagcugcagcaaggaggacacccagaagugcgugaacaccaagcuggagcagccccagagcauccugaucgagcacaagggcaccaucaucggcaagcagaacgacaccugcaccgccaaggccagcugcuggcuggagagcgugaagagcuucuucuacggccugaagaacaugcugagcggcaucuucggcaacguguucaucggcauccugcuguuccuggcccccuucaucaugcugauccuguucuucauguucggcuggagaauccuguucugcuucaagugcugcagaagaaccagaggccuguucaaguacagacaccugaaggacgacgaggagaucggcuacagaaagaucaucgagagacugaacaacaagaagggcaagaacaagcugcuggacggcgagagacuggccgacagaaagaucgccgagcuguucagcaccaagacccacaucggc

SEQ ID NO: 9207 - RNA, 1932 nt, Artificial Sequence
  derived and/or modified CDS sequence (opt4) from CCHFV(SR3)__AJ538199.1__Gc
uuccuggacagcaucgugaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaaggugcuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccugcaccggcgacugccccgagagaugcggcugcaccagcagcaccugccugcacaaggaguggccccacagcagaaacuggagaugcaaccccaccuggugcuggggcgugggcaccggcugcaccugcugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggcagcgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcgugcccggcgaccugcagguguaccacaucggcaaccugcugaagggcgacagagugaacggccaccugauccacaagaucgagcagcacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaccuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccggccugaccugcaccggcugcuacgccugcagcagcggcaucagcugcaaggugagaauccacguggacgagcccgacgagcugaccgugcacgugaagagcgacgaccccgacgugguggccgccagcagcagccugauggccagaaagcuggaguucggcaccgacagcaccuucaaggccuucagcgccaugcccaagaccagccugugcuucuacaucguggagagagaguacugcaagagcugcaacaaggaggacacccagaagugcgugaacaccaagcuggagcagccccagagcauccugaucgagcacaagggcaccaucaucggcaagcagaacaacaccugcaccgccaaggccagcugcuggcuggagagcgugaagagcuucuucuacggccugaagaacaugcugggcggcaucuucggcaacguguucaucggcaucuucaccuuccugacccccuucauccugcugauccuguucuucauguucggcuggagaauccuguucugcuucaagugcugcagaagaaccagaggccuguucaaguacagacaccugaaggacgacgaggagaccggcuacagaaagaucaucgagagacugaacaacaagaagggcaagaacagacugcuggacggcgagagacuggccgacagaaagaucgccgagcuguucagcaccaagacccacaucggc

SEQ ID NO: 9208 - RNA, 4656 nt, Artificial Sequence
  derived and/or modified CDS sequence (opt4) from DUGV(ArD44313)__NC_004158.1__GP
augagcaagagagugcugaucaucgccguggugguguaccugguguucaccacccagaaccagaucaccggcaaccacaccaccaucaacagcagcagccccagcaccaccgaggccagcagcacccccaccgugagcagaaccccccagaccaccaccaccagcaccgccgugagcaccaccaucaccgccaccaccacccccaccgccagcuggaccacccagagccaguacuucaacaagaccacccagcaccacuggagagaggagaccaugaucagcagaaaccccaccgugcuggacagacagagcagagccagcagcgugagagagcugcugaacaccaaguuccugaugcugcugggcuucauccccaagggcgaggugaaccaccuggagaacgccugcaacagagagggcaagaacugcaccgagcugauccugaaggagagaaucgccagauucuucagcgagaccgagaaggagagcugcuacaacaccuaccuggagaagcaccugagaagcgugagccccgaggugagccugacccccuacagagugcugggccugagagaggacauccugcugaaggagaucgacagaagaaucaucagauucgagaccgacagccagagagugaccugccugagcgccagccugcugaagcccgacguguucaucagagagcagagaaucgacgccaagcccagcaacggccccaagaucgugcccguggacagcguggccugcaugaaccuggaggccaacguggacgugagaagcaacaagcuggugauccagagccugaugaccaccgugaagaucagccugaagaacugcaaggugguggugaacagcagacagugcauccaccagcagaccggcagcggcgugaucaaggugcccaaguucgagaagcagcagggcggcaccuggagcagcuacaucgccggcguguacaccgccaccaucgaccugcuggacgagaacaaccagaacugcaagcuguucaccgagugcaucgugaagggcagagagcuggugaagggccagagcgagcugaagagcuucaacaucgaggugcugcugcccagagugaugaagaccagaagaaagcugcuggccgugaccgacggcagcaccgagugcaacagcggcacccagcugaucgagggcaagagcaucgaggugcacaagcaggacaucggcggccccggcaagaagcugaccaucugcaacggcaccagcgugcuggacgugccccuggacgagggccacggcugcuacaccaucaacgugaucaccagcaagagagccugcagacccaagaacagcaagcugcagugcagcaucgacaaggagcugaagcccugcgacagcggcaagugccugagcaucagccagaagggcgccggccacaucaaggugagcagaggcaagaccauccugaucaccgagugcaaggagcacugccagauccccgugcccaccggcaagggcgacaucaugguggacugcagcggcggcagacagcacuaccuggaggugaacaucguggacauccacugccccaacaccaaguuccugggcggcaucaugcuguacuucugcagaaugagcagcagacccaccguggcccugcugcugggcaucuggaucggcugcggcuacauccugaccugcaucuucagcuuccugcuguaccaccugauccuguucuucgccaacugcaucaagcagugcagaaagaagggcgagagacugggcgagaucugcgugaagugcgagcagcagaccgugaaccugauggaccaggagcugcacgaccugaacugcaacuucaaccugugccccuacugcugcaacagaaugagcgacgagggcaugagcagacacgugggcaagugccccaagagacuggagagacugaacgagaucgagcuguaccugaccaccagcgagugccugugccugagcgugugcuaccagcugcugaucagcgugggcaucuuccugaagagaaccaccuggcugguggugcugcuggugcugcugggccuggccaucagccccgugcagggcgcccccaccgaggugagcaacgugaagcaggacggcgacuacagcaucugcuacuucaucuucggcugccuggugaccgccgcccugcugcugaaggugaagagaaccaacagcaacggcaucgugguggugguggacagcuucggcagaugccccuacugcaacgaguucaccgacagccuguucgaggaggugcugcacgacacccugugcagccugugcgugugccccuucugcgagaagcaggcccuggaccuggugacccuggaggagcacgugaaggagugcuacaagguggccaccagaaaggacaucuucaagauccugggcagaaaguucaccaacgcccuggugagaagagagaagcuguucaccaccggccugcagcuguucaucaacaagaccaacguggugguguucgcccugaucaugugcuuccugcugcugcugaccggccacaacgccagcgccuucgacagcggcgaccugcccgacggcgugugggaggagagcagccagcuggugaagagcugcacccaguucugcuacaucgaggaggacgugugcuacugccccgccgaggacggcgugggcagaaagcugcuguucuucaacggccugcagaacagcgugaagagacugagcgacagccacaagcugcugaccagcgugagcaucgacgcccccuggggcagaaucaacguggagagcaccuggaagcccacccuggccgccagcaacaucgccaugagcuggagcagcaccgacaucaagggcgagaaggugauccugagcggcagaagcaccagcaucaucaagcugaaggagaagaccggcgugauguggaagcuggugggcagcggccuggccagcgagaagaagaagcccuucagauuccccaucauggacuucgcccagguguacaacagcguguuccaguacaucaccggcgacagacugcugagcgaguggcccaaggccgugugcaccggcgacugcccccacagaugcggcugccagaccagcaccugcauggccaaggagugccacacccaggagugcgugagcacccacauggugcugggcaucggcaccggcugcaccugcugcggcauggacguggagagacccuucaacaaguaccugggcgugaaguggagcaccgaguaccugagaaccgaggugcuggugugcguggaggugaccgaggaggagagacacugcgagaucguggaggccggcaccagauucaacaucggccccaucaccaucaccaucagcgacccccagaacaucggcagcaagcugcccgagagccugaugaccgugcaggagaucgacgacagcaacuucguggacaucaugcacgugggcaacgugaucagcgccgacaacagcugcagacugcagagcugcacccacggcagcgccgugaccaccagauucaccgcccugaccgcccugaucaaggacgaccacagcagcggccugaaccuggccgugcuggaccccaaggugaacagcagcuggcugagcugggagggcugcgacauggacuacuacugcaacgugggcgacuggcccaccugcaccuacaccggcguggugacccagaagcugagagaguuccugaagcuggaccagcacagaaagagacugcacaccacccugagcuucagccugaagaagaaccugagcaagagaagccacaccagcgugagacuggagggcaagaccgugaccagaauggaggugaaggugaccgcccugaucgagguggacggcauggagcugcacagcaagaccaucagacugagcggcaucagacugaccggccugaagugcagcggcugcuucagcugcaccagcggcaucagcugcagcgugaacgccaagcugaccagccccgacgaguucacccugcaccugagaagcaccagccccaacguggugguggccgagaccagcaucaucgccagaaagggccccagcgccaccaccagcagauucaagguguucagcgugagagacaccaagaagaucugcuucgaggugguggagagagaguacugcaaggacugcacccccgacgagcugaccaccugcaccggcguggagcuggagcccaccaaggacauccugcuggagcacagaggcaccaucgugcagcaccagaacgacaccugcaagagcaagaucgacugcuggagcaacagcaucagcagcuucgccagcggcaucggcgacuucuucaagcacuacaucggcagcaucgccgugggcgugcugggcaccgugcugcccuucgcccugcugauccuguucuucaucuacggcgacaagaugcuguggcccuucaagguguucugcagacccugcagaagaugcugcagaaagaacgagggcuacaacaagcuggccgaggaggaggagcugagagacaucaucagaaaguucagcaagagcggcgagcugaucaacaaggacgccaaggacaagagaacccuggccagacuguucaugagcgacaaccccaagcugaagaaggagaagaagcugagcgagaucgccuga

SEQ ID NO: 9209 - RNA, 4656 nt, Artificial Sequence
  derived and/or modified CDS sequence (opt4) from DUGV(IbAr1792)__KU925456.1__GP
augagcaagagagugcugaucaucgccgugguggugugccugguguucaccacccagaaccagaucgccggcaaccacaccaccgccaacagcggcagccccagcaccaaggaggccagcagcaugcccaccgugagcgacaccccccagaccaccaccaccagcaccgccgugagcaccaccaucaccgccaccaccacccccaccgccagcuggaccacccagagccaguacuucaacaagaccacccagcaccacuggagagaggagaccauggugagcagaaaccccaccgugcugaacagacagagaagagccagcagcgugaaggagcugcugaacaccaaguuccugaugcugcugggcuucauccccaagggcgaggugaaccaccuggagaacgccugcaacagagagggcaagaacugcaccgagcugauccugaaggagagaaucgccagauucuucagcgagaccgagaaggagagcugcuacaacaccuaccuggagaagcaccugugcagcgugagccccgaggugagccugacccccuacagagugcugggccugagagaggacauccugcugaagaagaucgacagaagaaucaucagauucgaggccgacagccagagagugaccugccugagcgccagccugcugaagcccgacguguucaucagagagcagagaaucgacgccaagcccagcaacggccccaagaucgugcccguggacagcgugagaugcaucaaccuggaggccaacguggacgugagaagcaacaagcuggugauccagagccugaugaccaccgugaagaucagccugaagaacugcaaggugguggugaacagcagacagugcauccaccagcagaccggcagcggcgugaucaaggugcccaaguucgagaagcagcagggcggcaccuggagcagcuacaucgccggcguguacaccgccaccaucgaccugcuggacgagaagaaccagaacugcaagcuguucaccgagugcaucgugaagggcagagagcuggugaagggccagagcgagcugaagagcuucaacaucgaggugcugcugcccagagugaugaagaccagaagaaagcugcuggccgugaccgacggcagcaccgagugcaacagcggcacccagcugaucgagggcaagagcaucgaggugcacaagcaggacaucggcggccccggcaagaagcugaccaucugcaacggcaccagcgugcuggacgugccccuggacgagggccacggcugcuacaccaucaacgugaucaccagcaagagagccugcagacccaagaacagcaagcugcagugcagcaucgacaaggagcugaagcccugcgacagcggcaagugccugagcaucagccagaagggcgccggccacaucaaggugagcagaggcaagaccauccugaucaccgagugcaaggagcacugccagauccccgugcccaccggcaagggcgacaucaugguggacugcagcggcggcagacagcacuaccuggaggugaacaucguggacauccacugccccaacaccaaguuccugggcggcaucaugcuguacuucugcagaaugagcagcagacccaccguggcccugcugcugggcaucuggaucggcugcggcuacauccugaccugcaucuucagcuuccugcuguaccaccugauccuguucuucgccaacugcaucaagcagugcagaaagaagggcgagagacugggcgagaucugcgugaagugcgagcagcagaccgugaaccugauggaccaggagcugcacgaccugaacugcaacuucaaccugugccccuacugcugcaacagaaugagcgacgagggcaugagcagacacgugggcaagugccccaagagacuggagagacugaacgagaucgagcuguaccugaacuacaagagagugcccagcugccugagaugcaugcugagcaccagcaucagcgugggcaucuuccugaagagaaccaccuggcugguggugcugcuggugcugcugggccuggccaucagccccgugcagggcgcccccgccgaggugagcaacgugaagcaggacggcgacuacagcaucugcuacuucaucuucggcugccuggugaccgccgcccugcugcugaaggugaagagaaccaacagcaacggcaucgugguggugguggacagcuucggcagaugccccuacugcaacgaguucaccgacagccuguucgaggaggugcugcacgacacccugugcagccugugcgugugccccuucugcgagaagcaggcccuggaccuggugacccuggaggagcacgugaaggagugcuacaaggugaccaccagaaaggacaucuucaagauccugggcagaaaguucaccaacgcccuggugagaagagagaagcuguucaccaccggccugcagcuguucaucaacaagaccaacguggugguguucgcccugaucaugugcuuccugcugcugcugaccggccacaacgccagcgccuucgacagcggcgaccugcccgacggcaucugggaggagagcagccagcuggugaagagcugcacccaguucugcuacaucgaggaggacgugugcuacugccccgccgagaacggcgugggcagaaagcugcuguucuucaacggccugcagaacagcgugaagagacugagcgacagccacaagcugcugaccagcgugagcaucgacgcccccuggggcgccaucaacguggagagcaccuggaagcccacccuggccgccagcaacaucgccaugagcuggagcagcaccgacaucaagggcgagaaggugauccugagcggcagaagcaccagcaucaucaagcugaaggagaagaccggcgugaugugggagcugggcagcgagcuggccagcgagaagaagaagcugcuggugagcaucauggacuucgcccagguguacaacagcguguuccaguacaucaccggcgacagacugcugagcgaguggcccaaggccgugugcaccggcgacugcccccacagaugcggcugccagaccagcaccugcauggccaaggaguggccccacaccagaaacuggagaugcaaccccaccuggugcuggggcaucggcaccggcugcaccugcugcggcauggacguggagagacccuucaacaaguaccugggcgugaaguggagcaccgaguaccugagaaccgaggugcuggugugcguggaggugaccgacgaggagagacacugcgagaucguggaggccggcaccagauucaacaucggccccaucaccaucaccaucagcgacccccagaacaucggcagcaagcugcccgagagccugaugaccgugcaggagaucgacgacagcaacuucguggacaucaugcacgugggcaacgugaucagcgccgacaacagcugcagacugcagagcugcacccacggcagcgccggcgacuaccagaucuacagcaccgacagccugaucaaggacgaccacagcagcggccugaaccuggccgugcuggaccccaaggugaacagcagcuggcugagcugggagggcugcgacauggacuacuacugcaacgugggcgacuggcccaccugcaccuacaccggcguggugacccagaacagcgagagcuucagcaaccugaucaacaucgagaaggacuacacccagagauuccacuuccacagcaagagaaucagcgccaagggccacacccugcagcuggaccugaaggccagacccaaccaggacggcggcgaggugaccgcccugaucgagguggacggcauggagcugcacagcaagaccaucagacugagcggcaucagacugaccggccugaagugcagcggcugcuucagcugcaccagcggcaucagcugcagcgugaacgccaagcugaccagccccgacgaguucacccugcaccugagaagcaccagccccaacguggugguggccgagaccagcaucaucgccagaaagggccccagcgccaccaccagcaaguucaagguguucagcgugagagacaccaagaagaucugcuucgaggugguggagagagaguacugcaaggacugcagccccgacgagcugaccaccugcaccggcguggagcuggagccccccaaggacauccugcuggagcacagaggcaccaucgugcagcaccagaacgacaccugcaagagcaagaucgacugcuggagcaacagcaucagcagcuucgccagcggcaucggcgacuucuucaagcacuacaucggcagcaucgccgugggcauccugggcaccgugcugcccuucgcccugcugauccuguucuucaucuacggcgacaagaugcuguggcccuucaagguguucugcagacccugcagaagaugcugcagaaagaacgagggcuacaacaagcuggccgaggaggaggagcugagagacaucaucagaaaguucagcaagagcggcgagcugaucaacaaggacgccaaggacaagagaacccuggccagacuguucaugagcgacaaccccaagcugaagaaggagaagaagcugagcgagaucgccuga

SEQ ID NO: 9210 - RNA, 4884 nt, Artificial Sequence
  derived and/or modified CDS sequence (opt4) from NSDV(Jilin)__NC_034391.1__GP
auggugagccuggagaagggccugauccugcugcugcugaugcacaucgccaucgccagcaccggcggcagccugggccugcccggccugaacggcgaggaccacaccgacgaccccgaggugggcggcgacggccccaccgaggaguacaccgaggacgaccccgagagcaccaccgugagcauccccaccaccccccccgugcugggccagggcaccgaggaggugcccgccaccagcggcgaggccgaggccggcuacagcaccaccgacgugcccgacaccgugagcgagaagguggaggacgagcaggacaccacccccagcacccaggugacccccgaccagcccgagcagagcaccaccagccugcccgaccccuggaccgccaucagcaccagaaucggcagagagcugcugagcguggagagcgacaccaccaagagcagccuggugaccgugggccacccccagcagcccaucuuccuggacggccagcccguggaggaggugacccaccccgugaacgagagagacgugaccgaggcccugagaaaguacgacaagaugaagaagcugcugagccagagaauccugagcaagaugggcauggccagagacuucaccgacgaggagcuggacguguggugccacgagagauucgacaacugcagcagcaacgacaucgagaacagaaucagagacuucuuccugaucagcgaccagaccgagugcuucgacgaggugcuggugaagagacugugcgagagcaccaaccccaucgugggcgagcccuggcagguggccggcaucaaggaggagaucgugagaagagagaugggcagaagaaucuucagauucuucacccccacccugaaggugaccugcgugagcggcagccugaaccccagcgaccaguucgugagauucuacgaccccgugaucgagagaaccagcggccccaccauccagaacuacgacagcaugcacugccugaacaucgagaacggccuggccaagcccagcaagaugguggugcugaacgugcugaugaccaccguggaggugagacuggagagcugcagagccuucaucaacgcccaccagugcaucuacacccagcacgccgacggccaggugauggugcccaccuucguggaccacagcggcaccagaagaaccaucggcgccuacaccaugagcuucaaccugaccgacgagagaaacagagccugcaucaucagaaccaccugcguggugaagggcaaggaggugaagaagggccagagccagcugagaggcuuccccaccagcaucagacuguucaagagcgugaccggcaagagaagacugauggccgaggagggcgacuggaccgacugcggcagcggcacccagcuggacaugaccauggccgugagcgugcacaacgacaagaagggcggccccggcaagaagcugaccaucugcaacggcaccaccgugagcgacagcacccugaacgagggccugggcugcuacaccaucaacaaggugaucaccggcaaggccugcaaggugggcaacagcaccggcagcugcgaggugcagaccgagcugcagaagugcgagaccggcaagugcauccuggugaagcagaagagcaagggcguggugaagcugaagagaggcaagaccgugaucaucaccgagugccagggcagcugccuguucgccaucccccaggacaccggcgacaucaccaucgacugcagcggcggcagacagcacuaccuggagaucaacaucguggacauccacugccccggcaaggacaaguggaagggcuucaugcuguacaucugcagagugagcagcagaccccugaucgcccugaccuucggccuguggcuggccgccggcuaccugaucaccugccuggugagcuucaucaucuacaacgccgugcugcugcugagcaucgccaucaagaaggugagacagggcagagagaagaagggcgaccugugcaucaagugcgagcagcacugcaugaaccuguacgaccaggagcugcacgagcugaacugcagcuucaaccugugccccuacugcgccaacagacugagcgacgagggccugcccagacacgugcccagaugccccaagaagagcgagagacuggaggagaucgagcuguacaucaacuacaccagagugcccugcauccugagauggauccugagcaccagcgugcaggugggcaccgccgugaagagacugagcugguucagcgugcuggugacccuguucauccugaccaucagccccgugcagggcuucccccuggagagcccccccaucggcgccgccaccgacagcagaaucauguacggcguggugggcuucauguucgcccugaucaugaugcugaaccugaagaagagccacuacggcagcaucuuccacgugaucgacggcuucggcagaugcaaccugugcgacaccagaaucgacagccugauggaggagaccgcccacgaccugugcugcauguucgacugcugccccuacugccacagagugagcgagagcaacggcagccacugcuuccacgugagaaucugcguggccaaggagaucagcaagaagaugcugaaggccggcggcagacuguucaccaacaagcuggugagcagagagggcaccuucgccaacagaauccagcugcuguacagaagaagcaagguggugagcacccugguggugaccgugcugcugcugcuggugcugcugaagcccaccaccgccuucgacagcggcccccugcccgacggcaccugggaggaggaggagaagcuggugagaaacugcggccaggagugcauccuggaccagggcgagugccugugccccggcgagcacagagccggcagaaagcugcuguuccugaacggccugcaggacgccgccagaagaaugaccgagagccacagacugcugaccagcgugagcaucgacgcccccuggggcgccaucaacaucgagagcaccuucaagcccgugcuggccgccagcaacaucgaccugagcuggaacagcgccgaggagcagggcgacaagaucauccugagcggcagaagcaccggcaucaucaagcugcaggagagaaccggccugauguggaagaugagcagcgagaaggccagcgagagcaagaaccugcuggugagcgugauggacuucagccagcuguacaacagcaucuuccaguacaucaccggcgacagaagccugagcgaguggcccaaggccgugugcaccggcgacugccccgacagaugcggcugccagaccagcaccugcuaccacaaggaguggccccacaccagaaacuggagaugcaaccccaccuggugcuggggcaucggcaccggcugcaccugcugcggcauggacguggagagauacuucaacaaguacuucggcgugaagugggcccuggaguacgugagaaccgacgugguggugugcguggagcugaccaacgaggagagacacugcgaccuggugcaggccggcagcagauucagcaucggccccgugagcgugacccugagcgacccccagaacguggugaacagacugagcagcaacaucaugaccauccaggagaucgccgacaacggcauccuggaccugaugcacgugagcaaggugaucagcgccgagaacgccugcaagcugcagagcugcacccacggcagccccggcgaccugcagauccugcacaccgacaaccugaucaagggcgacaugagcggcggcaucaaccuggcccaccuggacccccaggugaacaccagcuggaugagcugggagggcugcgaccuggacuacuacugcaccgugggcgacuggcccagcugcaccuacaccggcgugaacagcaucaacaccgacagcuucaccaaccugaucaacaccgagaccgacuacaccggcaaguuccacuuccacagcaagagaaucagcgccagagacgacacccugcagauggaccugaaggccagacccaacagcggcggcggcgagaugaccgugcugguggaggugaacggccuggagcugcacagcaagagaaucagccugaagggccugagacugaccaaccugaagugcgacggcugcuucgccugcagccagggccugaccugcaccaucaccgccaagcuggagagccccgacgaguucaccauccaccugagaagcaccagcagagacguggugguggccgagaccagcgugaccgccagaaagguggagaccggcgccagaagcggcuucagagccuucgccgugagagacgugaagaagcugugccuggaggugguggagaaggacuacugccccagcugcaccguggaggaccugaagaucugcguggacgugagccuggagccccccaaggacauccugaucgagcacaagggcaccaucauccagcacuacaacaagagcugcgacgagggcuacaacugcugggugggcagcgugagcggcuucuucgugggcgugaaggacuucuucgagaagaaccugggcggcgugcugaucggccuggugagcaccauccugccccuggugcugaccgugcuguucuucaucuacggcaagaagcuguucugccugugcagacugugccacaagaagugcugcagaggcagcggcagaggcagagacggcuacagcagacugagccaggaggaggagaucaaggagaucaucaagaaguucagcagaaacggcgagcugcugggcaagggcgagaacgacaagagaaccguggccagaauguucauggacggccagagcaccaagaaggccaucaaggagguggccuga

SEQ ID NO: 9211 - RNA, 4884 nt, Artificial Sequence
  derived and/or modified CDS sequence (opt4) from NSDV(708)__EU697952.1__GP
auggugagccuggagaagggcuucuucuuccugcugcugcugcacaucgugaccgccagcaccggcggcccccccggccugcccggccccaacggcaaggaccagaccgacggccccgagggcggcggcgacggccccaccgaggaguacaccgaggacgacuucgagagcaccaccuucagcauccccaccaccccccccgugagcgagcaggacgccaaggaggugagcgccaccagcgaggaggccgagguggaggacagcacccugaucgugcccaagaccaugagcgagaaggugggcgacgagcagagcaccaccagcaacaugcaggugaccaccagccagcccgagcagagcaccaccggcaugcccggccccuggauggccagcagcaucaagaucggcagagagcugcugagcguggagagcgacaccaccaagagcagccuggugaccgugggcuacccccagcagcccaucuuccuggacggccagcccguggaggaggugacccaccccgugagcgagagagacguggccgaggcccugagaaaguacgacaagaugaagaagcugcugagccagagaauccugagcaagaugggcauggccagagacuucaccgacgacgagcuggacgccuggugccacgagagauucgacaacugcagcagcaacgacaucgagaacagaaucaaggacuucuuccugaucagcgaccagaccgagugcuucgacgaggugcuggugaagagacugugcgagagcaccaaccccaucaucggcgagcccuggcagguggccggcaucaaggaggagguggugagaagagagaugggcagaagaaucuucagauucuucacccccacccugaaggugaccugcgugagcggcagccugaaccccagcgaccaguucgugagauucuacaaccccgugaucgagagaaccagcggccccaccauccagaacuacgacagcaugcacugccugaacaucgagaacggccugaucaagcccagcaagguggugauccugaacgugcugaugaccaccguggaggugagacuggagagcugcagagccuucgugaacgcccaccagugcaucuacacccagcacgccgacggccaggugagagugcccaccuucguggaccacagcggcaccaagagaaccaucggcgccuacaccaugagcuucaaccugaccgacgagagaaacaaggccugcaucaucagaaccaccugcguggugaagggcaaggaggugaagaagggccagagccagcugagaggcuuccccaccagcaucagacuguucaagagcgugaccggcaagagaagacugauggccgaggagggcgacuggaccgacugcggcagcggcacccagcuggacaugaccaccgccgugagcgugcacaacgacagaaagggcggccccggcaagaagcugaccaucugcaacggcaccaccgugagcgacagcacccugaacgagggccugggcugcuacaccaucaacaaggugaugaccggcaaggccugcaaggugggcaacagcaccggcagcugcgaggugcagcccgagcugcagaagugcgagaccggcaagugcauccuggugaagcagaagaacaagggcguggugaagcugaagagaggcaagaccgugaucaucaccgagugccagggcagcugccuguucgccaucccccaggacaccggcgacaucaccaucgacugcagcggcggcagacagcacuaccuggaggugaacaucguggacauccacugccccggcaaggacaaguggaagggcuucaugcuguacaugugcagagugagcagcagaccccugaucgcccugaccuucggccuguggcuggccgccggcuaccugaucaccugccuggugagcuucaucaucuacaacgccgugcugcugcugagcaucgccaucaagaaggugagacagggcagagagagaaagggcgaccugugcaucaagugcgagcagcacugcaugaaccuguacgaccaggagcugcacgagcugaacugcagcuucaaccugugccccuacugcgccaacagacugagcgacgagggccugcccagacacgugcccagaugccccaagaagaccgagagacuggaggagaucgagcuguacaucaacuacaccagagugcccugcauccugagauggauccugagcaccagcgugcaggugggcaccgccgugaagagacugagcugguucagcgugcuggugauccuguucgugcugaccaucagccccgugcagggcuucccccuggagaacacccccaucggcagcaccaccgacagcagaaucaucuacggcguggugggcuucaucuucgcccugaucaugaugcugaaccugaagaagagccacuacggcagcaucuuccacgugaucgacggcuucggcagaugcaaccugugcgacaccagaaucgacagccugauggaggagaccgcccacgaccugugcugcaucuucgacugcugccccuacugccacagagugagcgagagcaacggcagccacugcuuccacgugagaaugugcguggccaaggagaucagcaagaagaugcugaaggccgccggcagacuguucaccaacaagcuggugagcagagagggcaucuucgccaacagagugcagcugcuguacagaagaagcaagguggugagcaccuucguggugaccgugcugcugcugcugguguuccugagacccgccaccgccuucgacagcggcccccugcccgacggcaccugggaggaggaggagagacuggugagaaacugcggccaggagugcgugcuggaccaggacgagugccugugccccggcgagaacagagccggcagaagacugcuguuccugaacggccugcaggacgccgugagaagaaugaccgagagccacagacugcugaccagcgugagcaucgacgcccccuggggcgccaucaacaucgagagcaccuucaagcccgugcuggccgccagcaacaucgaccugagcuggaacagcgccgaggagcagggcgacaagaucauccugagcggcagaagcaccggcaucaucaagcugcaggagagaaccggccugauguggagaaugagcagcgagaaggccagcgagagcaagaaccugcuggugagcgugauggacuucagccagcuguacaacagcaucuuccaguacaucaccggcgacagaagccugagcgaguggcccaaggccgugugcaccggcgacugccccgacagaugcggcugccagaccagcaccugcuaccacaaggaguggccccacaccagaaacuggagaugcaaccccaccuggugcuggggcaucggcaccggcugcaccugcugcggcauggacguggagaaguacuucaacaaguacuucggcgugaagugggcccuggaguacgugagaaccgacgugguggugugcguggagcugaccaacgaggagagacacugcgaccuggugcaggccggcagcagauucagcaucggccccgugagcgugacccugagcgacccccagaacguggugaacagacugagcagcaacaucaugaccauccaggagaucgccgacaacggcauccuggaccugaugcacgugagcaaggugaucagcgccgagaacgccugcaagcugcagagcugcacccacggcagccccggcgaccugcagauccugcacaccgacaaccugaucaagggcgacaugagcggcggcaucaaccuggcccaccuggacccccaggugaacaccagcuggaugagcugggagggcugcgaccuggacuacuacugcaccgugggcgacuggcccagcugcaccuacaccggcgugaacagcaucaacaccgacagcuucaccaaccugaucaacaccgagaccgacuacaccagcaaguuccacuuccacagcaagagaaucagcgccagagacgacacccugcagauggaccugaaggccagacccaacaccggcggcggcgagaugaccgugcugguggaggugaacggccuggagcugcacagcaagagaaucaaccugaagggccugagacugaccaaccugaagugcgacggcugcuucgccugcagccagggccugaccugcaccgugaucgccaagcuggugagccccgacgaguucaccauccaccugagaagcaccagcagagacguggugguggccgagaccagcaucaccgccagaaagguggacaccggcgccagaagcagcuucagagccuucgccgugagagacgugaagaagcugugccuggaggugguggagaaggacuacugccccagcugcaccguggacgaccugaagaugugcguggacgugagccuggagccccccaaggacauccugaucgagcacaagggcaccaucauccagcacuacaacaagagcugcgacgagggcuacaacugcugggugggcagcgugagcggcuucuucgugggcgugaaggacuucuucgagaagaaccugggcggcgugcugaucggccuggugggcaccauccugccccuggugcugaccauccuguucuucaucuacggcaagaagcuguucuaccugugcagacugugccacaagaagugcugcaagggcagcggcagaggcagagacggcuacagcagaaucagcagagaggaggagaucaaggagaucaucaagaaguucagcagaaacggcgagcugcugggcaagggcgagaacgacaagagaaccguggccagaauguucauggacggccagagcaccaagaaggccaucaaggagguggccuga

SEQ ID NO: 9212 - RNA, 4875 nt, Artificial Sequence
  derived and/or modified CDS sequence (opt4) from NSDV(779)__HQ286599.1__GP
auggcccugguggccaagggccugauccugaugcugcugcuguacauguucaaggccagcgaggugaaccuggagcugcccagcuggaacagcaccgagggcaccgaguacgccgacgagcugcccaccgagccccccagcgaggaggagcccaagcuggccgccgugagcaccgugaccacccccgccccccccaaggagagcaccgaggacaccaucgagagccccgacggcggcgagaccauggcccccaccacccccgcccccgugaccgacagcgccagcaagcuggaggaggagcccggcaccacccagcaggcccagagcacccagaugcagaacagccaggcccccaucggcaugcccgaggccuggagcaccagccccagcagagugggcagaaagccccugagcgccagccccgacgugagcgagcccgaccagaacaccgaggcccagacccacccccccguguuccuggacggcagacccguggaggaggaggagcacagcgugggcaccagagacguggccagcgaccugagagaguacaaccagaugaagcagcugcugagccagagaauccuggccaagaugggcauggccguggacuucaccgacgacgagcuggacaccuggugcuacagaagauacagcaacugcagcagcaacgacaucgagagcagaaucagagacuucuuccugaucaccgacagaagcgagugcuucgacgaggugcuggugaagagacugugcgagaccaccagccccaucaucgacagagccuggaagaucgccggccugaaggaggagguggugcugagagagaugggcagaagaaucuucagauucuucacccccgcccugaaggugaccugcaugagcggcagccugaaccccagcaaccaguucgugagauucuacaaccccacccuggagagaaccagcggccccaccauccagaacuacgacggcaugcacugccugaacaucgagaacggccugaucaagcccagcaaggugguggugaucaacgugcugaugaccaccguggacaucagacuggagagcugcagagccuucaucaacgcccagcagugcaccuacacccagcacgccgacggccuggugagagugcccaccuucgugggcccccacggcgagaagagaaucaucggcgccuacaccaugagcuucaaccugaccgacgagaagaacaaggccugcaccaucaagaccaccugcguggugaagggcaaggaggugaagaagggccagagccagcugagaggcuuccccaccaccaucagacuguucaagagcgugaccggcaagagaagacugaugagcaacgaggaggaguggaccgagugcggcagcggcacccagcugaacauggccaccgccgugagcgugcacaacgacaagcugggcggccccggcaagaagcugaccaucugcaacggcaccaccgugagcgacaucgcccugaacgagggccugggcugcuacaccaucaacaagaucaucaccggcaaggugugcaagaccggcaacaccaccggcagcugcgaggugcagcccgagcugcagaagugcgagaccggcaagugcauccugaucaagcagaagaacaagggcguggugaagcugaagagaggcaagaccgugaucaucaccgagugccagggcagcugccuguucgccaucccccaggacaccggcgacaucaccaucgacugcagcggcggcagacagcacuaccuggagaucaacaucguggacauccacugccccggcaaggacaaguggaagggcuucaugcuguacaucugcagagugagcagcagaccccugguggcccugaccuucggcaucuggcugaccgccggcuaccugaucaccugccuggccagcuucauccuguacaacgccauccugcugaucagcaucgccaucaagaagcugaagcagaagagagagaagaagggcgaccugugcaucaagugcgagcagcacugcaugaaccuguacgaccaggagcugcacgagcugaacugcagcuucaaccugugccccuacugcgccaacagacugagcgacgacggccugcccagacacgugcccagaugccccaagagaggcgagagacuggaggagaucgagcuguacaucaacuacaccagagugcccugccugcugagaugggcccugagcaccagcgugcaggugggcaccgugaucaagagacugagcugguucggcgugcugcugacccuguucuuccugaccaucagccccgugcagggcuucccccuggagaacccccccaucggcaccgccaccgacagcaacaucaucuacggccuggccggcuucaucuucgcccuggugcugaugcugaaccugaagaagacccacuacggcagcguguuccacgugaucgacggccugggccugugcagccugugcgacaccagaaucgacagccugauggaggagaccgcccacgagcugugcugcgccuucgacugcugccccuacugccaccaggugagcgagagcaacggcagccacugcuuccacaugagaaucugcgugagcaaggagaucagcaagaagaugcugaaggccgccggcaagcuguucaccaacaagcuggugagcagagagggcuucuucgccaacaagauccagcugcuguaccagagaagcaagguggugagcacccugauccugaccgugcugcugcugcugaucauccugaagcccgccgccgccuucgacagcggcccccugcccgacggcaccugggaggaggaggagagccugaucagaagcugcgaccaggagugcgugcuggagcaggacgagugccugugccccggcgagcacagagccggcagaagacugcuguuccugagcggccugcaggacgccgccagaagaaugaccgagagccacagacugcugaccagcgugagcaucgacgcccccuggggcgccaucaacaucgagagcaccuucaagccccugcuggccgccagcaacaucgaccugagcuggaacagcgccgaggagcagggcgacaagaucgugcugagcggcagaagcaccggcaucaucaagcugcaggagagaaccggccugauguggaagaugagcagcgagaaggccagcgagagcaagaaccugcuggugagcaucauggacuucagccagcuguacaacagcaucuuccaguacaucaccggcgacagaagccugagcgaguggcccaaggccgugugcaccggcgagugccccgacagaugcggcugccagaccagcaccugcuaccacaaggaguggccccacaccagaaacuggagaugcaaccccaccuggugcuggggcaucggcaccggcugcaccugcugcggcauggacguggagagauacuucaacaaguacuucggcgugaagugggcccuggaguacgugagaaccgacgugguggugugcguggagcugaccaacgaggagagacacugcgaccuggugcaggccggcagcagauucagcaucggccccgugagcgugacccugagcgacccccagaacguggugaacagacugagcagcagcaucaugaccauccaggagaucagcgacaacggcauccuggacgugaugcacgugagcaaggugaucagcgccgagaacgccugcaagcugcagagcugcacccacggcagccccggcgaccugcagauccugcacaccgacaaccugaucaagggcgagaugagcagcggcaucaaccuggcccaccuggacccccaggugaacaccagcuggaugagcugggagggcugcgaccuggacuacuucugcaccgugggcgacuggcccagcugcaccuacaccggcgugaacagcaucaacaccgacagcuucaccaaccugaucaacaccgagaccgacuacaccagcaaguuccacuuccacagcaagagaaucagcgccagaggcgacacccugcagauggaccugaaggccagacccaacgugggcggcggcgagaugaccgugcugguggaggugaacggccuggagcugcacagcaagaagaucagccugaagggccugaagcugagcaaccugaagugcagcggcugcuucgccugcagccccggccugagcugcaccgugaucgccagacuggagagccccgacgaguucaccauccaccugagaagcaccagcagagacguggugguggccgagaccagcgugaccgccagaaaggccgagaccggcgccaagagcagcuucagagccuucgccgugaaggacgugaaggagaucugccuggaggugguggagaaggaguacugccccagcugcagcaucgaggaccugaagaucugcaucagcgugacccuggagccccccaaggacauccugaucgagcacaagggcaccaucgugcagcacuacaacaagagcugcgacgagggcuacaacugcuggaucggcagcgugagcggcuucuucgugggcgugaaggacuucuucgagaagaacuucggcagcgugaucaucggcaucgugagcaccgugcugccccugauccugaccgugcuguucuucguguacggcagaagacuguucugccugugcagacugugccacaagaagugcugcagaggcagcagcagaggcagagacggcuacagcagacugagccaggaggaggagaucaaggagaucaucaagaaguucaacagaaacggcgagcugcugggcagaggcgagaacgacaagagaaccguggccagaauguucauggacagccagagcgccagaaaggccgugaaggagguggccuga

SEQ ID NO: 9213 - RNA, 4302 nt, Artificial Sequence
  derived and/or modified CDS sequence (opt4) from BUNV__NC_001926.1__GP
augagaauccugauccugcugcuggccgugacccagcuggccgugagcagccccgugaucaccagaugcuuccacggcggccagcugaucgccgagagaaagagccagaccagcaucagcgaguucugcaucaaggacgacgugagcaugcugaagagcgagaucguguacaccaagaacgacaccggcaucuucggccacagcaagguguucagacacuggaccaucaccgacuggaaggccugcaaccccguggugaccgccggcggcagcaucaacgugaucgagguggacaagaaccugaaccuggugaccagaaacuacgugugcaccggcgacugcaccaucaccguggacagaaagaacgcccagaucaucuuccagaccgacaagcugaaccacuucgaggugaccggcaccaccaucagcaccggcugguucaagagcaaggccagcgugacccuggacagaaccugcgagcacaucaaggugagcugcggcaagaagacccugcaguuccacgccugcuucaagcagcacaugagcugcgugagauuccugcacagaagcauccugcccggcagcauggccaucagcaucugccagaacaucgagcugaucaucaucaccauccuggcccugugcaucuucaucaucaugaucauccugaccaagaccuacaucugcuacgugcugauccccguguucaugcccaucgccuucgccuacggcugggccuacaacagaagcugcaagaagugcaccugcugcggccuggccuaccaccccuucaccaacugcggcagcuacugcgugugcggcagcaaguucgagaccagcgacagaaugagaaugcacagagagagcggccugugccagggcuucaagagccugagaguggccagaagacugugcaagagcaagggcagcagccugaucaucagcauccugcugagcgugcugauccugagcuucgugacccccaucgagggcacccugaccaacuaccccaccgaccagaaguacacccuggacgagaucgccgacgugcugcaggccaagacccacgaggacagcaccaaguacuacaucauccuguacaccagccuguucggcgccggccugaccaucaucuucgccggcguggcccugggccugaccaucauccuggaggugcugaccaagaucaacgugaucuucugcaacgagugcaacauguaccacagcaagaagagcaucaaguacgugggcgacuucaccaacaagugcggcuucugcaccugcggccugcuggaggaccccgagggcgugguggugcacaaggccaagaagagcugcaccuacagcuaccagaucaacugggugagaggcaucaugaucuucguggccuuccuguucgugauccagaacaccaucaucaugguggccgccgaggaggacugcuggaagaacgaggagcugaaggaggacugcgugggcccccugaucgcccccaaggacugcaccgacaaggaccacaagaccuaccugagcgaggccagccugcuggccaccgccaagaagaucacccagguggacgccgagaacguggagauccugggcaagaccauggagagcgccaucagagugaucgagagacagaagaccuaccacagaaugcaccugcuggaggccguguuccugaacaagcacugcgacuacuacaagauguucgagcacaacagcggcuacagccaggugaaguggagaaugaugaucaagacccagcacuucgacaucugcgcccugcaggccaacagccccuucugcgcccagugcaucgccgacaacagcugcgcccagggcagcugggaguucgacacccacaugaacagcaccuacagcagcaagguggacaacuucaagcacgacuucagccuguuccugagaaucuucgaggccgccuuccccggcaccgccuacgugcaccugcugaccaacaucaaggagaagaagcccuaccaggccgugagcaugaucgagaagaucaagaagaaguuccccaacaacaagcugcugaucggcuaccuggacuucggcaaguaccugcugggccugagccacgccagcaccuacgagcugcagcagagacagcuggacaagcuguaccagcccaccgagcugaccagaagcggcggccagcagaccagccuggccaacagcguggugggccaggccaccaaggagugcaagaaguacaaggacgugagcugccugagccccagauucggcaucccccuggaggaccugaucagcugcugcgaccagcccaacuacaacaucuacaagaagcccaagaagguguacaaggcccacgacaaggaggagaccuggugcaucaacgaccagcacugccugguggacuucgugcccgccgaggccgacaccguggagaagcugaagcccaugaagugcuggcugguggaccccggcaagaacgacgacguguacagcaucgccaucaagaccugcagagugguggacaagggcgugugcaccgugaacagccagaaguggaacaucaucaagugcgacagcggcccccuguacuacagcgaccacauccccggcgaggacaccggcaacgacaucggccacuacugcgugagcgccggcugcaagaccgacagauaccccaucaaccccgacguggugaccgacugcgugugggaguucaccagcagaaagagccaguacaucggcaagaucagcaugcagagccuggaggacuacgagaaggcccugaccgacagacugacccacacccuggagaccuacagcuucgccccccuggagaaccugccccacaucaagcccguguacaaguacaucaccgcccagggcguggagaacagcgacggcaucgagggcgccuucaucaccgccagcauccccgccgccggcggcaccagcaucggcuacaacgugagaagcaaggacggcuucccccugcuggaccugaucguguucgugaagagcgccgugaucaagagcaccuacaaccacaucuacgacaccggccccaccaucagcaucaacaccaagcacgacgagcacugcaccggccagugccccagcaacaucgagcacgaggccaacuggcugaccuucagccaggagagaaccagcagauggggcugcgaggaguucggcugccuggccgugaacaccggcugcguguucggcagcugccaggacgugaucagacccgagaccaagguguacagaaaggccguggacgagguggugauccugaccgugugcaucaccuaccccggccacaccuucugcaccgagaucaacgccaucgagcccaagaucaccgaggagaucgagcugcaguucaagaccguggacaccaagacccugcccuacaucguggccgugaacaaccacaagcuguacagcggccagaucaacgaccugggcaccuucggccagaugugcggcaacgugcagaagaccaacagcagcauccugggcaccggcacccccaaguucgacuacaccugccacggcgccagcagaaaggacaucaucgugagaagaugcuacaacaacaacuucgacagcugcaagcugcugaaggaggagacccagcugaucuucaacgacgaccacgacaccaucaccguguacaacaccaaccaccugaucggcgagcuggccaucaagcugauccugggcgacauccaguacaagcuguucaccgagacccuggaccugcagaucgacgccaagugcgugggcugccccgacugcuucgagagcuacagcugcaacuuccagaucgugagcaacaucgacaccaucugcagccuggagggccccugcgacaccuuccacaacagaaucagcaucaaggccaugcagcagaacuacgccgugaagcugagcugccagaaggaccccagacccagcggcaccuucaagaucugcaacagagaguacaccgugguguuccacaccguggccaaggacgacaagaucgagaucaacgugggcgaccagaccagcuucaucaaggagaaggacgacagaugcaagaccuggcugugcagagugagagacgagggcaucagcgugaucuucgagcccaucaaggccuucuucggcagcuacuucagcaucuucuucuacaucaucgugguggugguggugggcuuccugaucaucuacaucuucaugcccauguucaugaagcugaaggaggugcugaaggccaacgagaagcuguaccugcaggagaucaagcagaaguga

SEQ ID NO: 9214 - RNA, 4311 nt, Artificial Sequence
  derived and/or modified CDS sequence (opt4) from BUNV(SFCrEq231)__KP063893.1__GP
augaagaugauccugcugaucaucauccugugcgugaaccuggccgccgccaaccccguggccaccagaugcuuccacggcggccagcugaucgccgagaccagaagcgccaccagcaucagcgaguucugccugaaggacgacgugagcaugaucaagagcgagaucaccuacaccaagaacgacaccggcaucuucggccacagcaagaucuacaagagcuggcugaucaaggacuggaagcugugcaaccccgugcccaccgccggcggcagcaucaacgugaucgaggugaacagcgaccugagccugaccaccaaggccuacgugugcagcagagacugcaccaucaccaucgacaaggaggaggcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucagacaccacaugagcugcgugagauucuuccacaacaccauccugcccggcaccauggugaacagcaugugccagaacaucgagcugaucaucauccugggccugacccugaucaucuucacccugauggugauccugaccaagaccuacaucugcuacauccugaugccccuguucaugcccaucgccuacgccuacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccugaucaucagcacccugcugagcaugcugcugcugagcuucaucacccccaucgagggcaccaugaccaacuaccccgagaccagacaguacagccuggaggagaucgccgacgugguggagggccugcugagcgagcagaacaucaaggaguacgugguguucuacaccagccuguucggcagccugauccugcugcuggccuucauccugagcaucacccugaccaaggugaccaacgcccuggccagaaccaacgugaucuacugcgaggagugcagcauguaccacgccaagaagggcaucaaguacaacggcgacuucaccaacaagugcggcuucugcaccugcgacgagcaggaggacgaggagggcaucaucauccacaaggugagcaagaagugcaccuacagauaccagcugcagugggccaagaucaucaugaucauccuggugaugcugcugaugaugcagaacaccauccugaucguggccgccgagaccgacugcuggaccaagaacagccuggagcuggacugcaucggcccccugcugaccaucagcgacugcagcaacaaggagagcaagaacuacgaggaggaggccgccaagcuggugagccagagcaagaucacccaggccgacgccgagcaggugaccauccugggcaacaccaucgacaccgcccugaaggccaucagaagccagaagaccuaccagaccaugcaccugcuggagagcguguuccugaugaagaacugcgacuacuacagcagcuucgagcccaacagcggcuacagccaggccaaguggagacugaucgccaagaccagccacuucgacaucugcagcagacacagcaugcaccacuucugcagaugcguggccgacggcaccaagugccagaacggcgacugggacuucgccggcgagaugaacaacaucuacagcaccaagaacgacuucuaccugcacgaccugaaccuguucuucacccugcacgagaccgccuuccccggcaccaccgagagccuguucuaccagcugaucgccaagaagaacaccaccggcgccagcaagcugcugggcaagcugaucaccaaguacggcaacaacaagcuguucgugggcaucuggaaguucggccaguaccugcugacccugcccuacgugaacaccaccgagcugagcaagaccagaagagagaccauccugaagacccaccagauccugaccagaagccagggcggcagaagcgagagcaugagcagcgccgaggugggccagaucgccaaggagugcgccaacgccaagaacgugggcugcaucagccccagauucggcauccccaucggcaaccugaccgccugcggcaacagccccaacuacaagaucuacaagacccccaacaagaucuacaagagcaacaacagaggcgagguguggugcagcgaggacgugcacugccuggccgacuucgagcccgccgacaccgagguggugaacaaggugaagaagaugaccugcuuccugagcgacgugaacaccagagccgacaucuucagcaucgccaucagcgccugcagaaugguggacaagggcgugugcaccgugaacggcgccaaguggaacauccugaagugcgagagcggccuguacuacuucaccgaccacagagagggccaggacaccggcaacgacuucggcgaguacugcaucagccacagcugcaacaccgagagauaccccaucaaccccgacauccugaaggagugcaucugggaguaccacagcagaaagagcaaguacaucagcaccaucaaccuggagagccuggaggaguucaagagagccaugagcgacaagcugagccacacccugaugguguacaacuucaagcccaccgccaaccugccccacaucaagcccagcuacaaguucaucaccgccaacggcaucgagaacagcgacggccuggagagcgccuacauccugagcagcauccccgccaucggcggcaugagcaucggcuacaacauccagaccaaggacaacuucccccugcuggaccugaucguguucgugaagagcgccgugaucaagaccaccuacaaccacaucuacgacaccggccccaccaucggcaucaacaccaaccacgacgagcacugcaccggccccugccccaccaucaucccccacaaggagaacuggcugaccuucagccaggagagaaccagcagauggggcugcgaggaguucggcugccuggccaucaacaccggcugcguguucggcagcugccaggacgugauccaccccgagaccaagaucuacagaaaggccguggaggaggagguggugcugaccgugugcaucaacuuccccggcaacaccuucugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccagagcauccugggcgccggcaccgugaaguucgacuacgugugccacggcgccagcagaaaggacaucaucgugagaagaugcuacaccaacaacuacgacagcugcaagcugcugaaggaggagagaagccugaucuucgccgacaaccacgagacccuggagguggccaacaccagacaccugaucggcgagcugcaguucaagaucaugcugggcgacaucagauacaaggccuucgccgagaagcccgagcuggagaucgacgccaagugcgugggcugccccagcugcuucgagagcuacagcugcaacuuccagaucgugaccagcaucgacaccgugugcagcguggagggccccugcacccuguuccacaacagaaucaucaucaccgccgccaagcagagcuacggcgugaagaugagcugcaagaccaagcccggccccguggaggaguucaccaucugcaacagaaacuacagagugagcuucgccaccaucgacaagaacgacaagaucgagaucaacaccggcgaccagaccagcuacaucguggagaaggacagcagaugcaagaccuggcugugcagagugagagacgagggcaucagcgugaucuucgagccccugaaggccuucuucggcagcuacuucagcaucgccuucuacaucaucaucggcaucgccgcccuguuccugaucaucuacaucuuccugcccauguucuucaagcugagagacgugcugaagaagaacgaguaccuguaccugcaggagcugaagcacaaguga

SEQ ID NO: 9215 - RNA, 4302 nt, Artificial Sequence
  derived and/or modified CDS sequence (opt4) from BUNV(GSA/S4/11232/WT)__KM507339.1__GP
augagaauccugauccugcugcuggccgugaccaagcuggccgugggcagccccguggugaccagaugcuuccacggcggccagcugaucgccgagagaaagagccagaccagcaucagcgaguucugcaucaaggacgacgugagcaugcugaagagcgagaucguguacaccaagaacgacaccggcaucuucggccacagcaagguguucagacacuggaccaucaccgacuggaaggccugcaaccccguggugaccgccggcggcagcaucaacgugaucgagguggacaagaaccugaaccuggugaccagaaacuacgugugcaccggcgacugcaccaucaccguggacaaggagaacgcccagaucaucuuccagaccgacagacugaaccacuucgaggugaccggcaccaccaucagcaccggcugguucaagagcaaggccagcgugacccuggacagaaccugcgagcacaucaaggugagcugcggcaagaagacccugcaguuccacgccugcuucaagcagcacaugagcugcgugagauuccugcacagaagcauccugcccggcagcauggccaucagcaucugccagaacaucgagcugaucaucaucaccauccuggcccugugcaucuucaucaucaugaucauccugaccaagaccuacaucugcuacgugcugauccccguguucaugcccaucgccuucgccuacggcugggccuacaacagaagcugcaagaagugcaccugcugcggccuggccuaccaccccuucaccaacugcggcagcuacugcgugugcggcagcaaguucgagaccagcgacagaaugagaaugcacagagagagcggccugugccagggcuucaagagccugagaguggccagaagacugugcaagagcaagggcagcagccugaucaucagcauccugcugagcgugcugauccugagcuucgugacccccaucgagggcacccugaccaacuaccccaccgaccagaaguacacccuggacgagaucgccgacgugcugcaggccaagacccacgaggacagcaccaaguacuacaucauccuguacaccagccuguucggcgccggccugaccaucaucuucgccggcguggcccugggccugaccaucauccuggaggugcugaccaagaucaacgugaucuucugcaacgagugcaacauguaccacagcaagaagagcaucaaguacgugggcgacuucaccaacaagugcggcuucugcaccugcggccugcuggaggaccccgagggcgugguggugcacaaggccaagaagagcugcaccuacagcuaccagaucagcugggugaagggcaucaugaucuucguggccuuccuguucgugauccagaacaccaucaucaugguggccgccgaggaggacugcuggaagaacgaggagcugaaggaggacugcgugggcccccugaucgcccccaaggacugcaccgacaaggacagaaagaccuaccugagcgaggccagccugcuggccaccgccaagaagaucacccagguggacgccgagaacguggagauccugggcaagaccauggagagcgccaucagagugaucgagagacagaagaccuaccacagaaugcaccugcuggaggccguguuccugaacaagcacugcgacuacuacaagauguucgagcacaacagcggcuacagccaggugaaguggagaaugaugaucaagacccagcacuucgacaucugcgcccugcaggccagcagccccuucugcgcccagugcaucgccgacaacagcugcgcccagggcagcugggaguucgacacccacaugaacagcaccuacagcagcaagguggacaacuucaagcacgacuucagccuguuccugagaaucuucgaggccgccuuccccggcaccgccuacgugcaccugcugaccaacaucaaggagaagaagcccuaccaggccgugagcaugaucgagaagaucaagaagaaguuccccaacaacaagcugcugaucggcuaccuggacuucggcaaguaccugcugggccugagccacgccagcaccuacgagcugcagcagagccagcuggacaagcuguaccagcccaccgagcugaccagaagcggcggccagcagaccagccuggccagcagcguggugggccaggccaccaaggagugcaagaaguacaaggacgugagcugccugagccccagauucggcaucccccuggaggaccugaucagcugcggcgaccagcccaacuacaacaucuacaagaagcccaagaagguguacaaggcccacaacaaggaggagaccuggugcaucaacgaccagcacugccugguggacuucgugcccgccgaggccgacaccguggagaagcugaagcccaugaagugcuggcugguggaccccggcaagaacgacgacguguacagcaucgccaucaagaccugcagagugaucgacaagggcgugugcaccgugaacagccagaaguggaacaucaucaagugcgacagcgaccugcuguacuacagcgaccacgugcccggcgaggacaccggcaacgacaucggccacuacugcgugagcgccggcugcaagaccgacagauaccccaucaaccccgacguggugaccgacugcgugugggaguucaccagcagaagaagccaguacaucggcaagaucagcaugcagagccuggaggacuacaagaaggcccugaccgacagacugacccacacccuggagaccuacagcuucgccccccuggagaaccugccccacaucaagcccguguacaaguacaucaccgcccagggcguggagaacagcgacggcaucgagggcgccuucaucaccgccagcauccccgccgccggcggcaccagcaucggcuacaacgugagaagcaaggacggcuucccccugcuggaccugaucguguucgugaagagcgccgugaucaagagcaccuacaaccacaucuacgacaccggccccaccaucagcaucaacaccaagcacgacgagcacugcaccggccagugccccagcaacaucgagcacgaggccaacuggcugaccuucagccaggagagaaccagcagauggggcugcgaggaguucggcugccuggccgugaacaccggcugcguguucggcagcugccaggacgugaucagacccgagaccaagguguacagaaaggccguggacgagaucgugauccugaccgugugcaucaccuaccccggccacaccuucugcaccgagaucaacgccaucgagcccaagaucaccgaggagaucgagcugcaguucaagaccguggacaccaagacccugcccuacaucguggccgugaacaaccacaagcuguacagcggccagaucaacgaccugggcaccuucggccagaugugcggcaacgugcagaagaccaacagcagcauccugggcaccggcacccccaaguucgacuacaccugccacggcgccagcagaaaggacaucaucgugagaagaugcuacaacaacaacuucgacagcugcaagcugcugaaggaggagacccagcugaucuucaacgacgaccacgacaccaucaccguguacaacaccaaccaccugaucggcgagcuggccaucaagcugauccugggcgacauccaguacaagcuguucaccgagacccuggaccugcagaucgacgccaagugcgugggcugccccgacugcuucgagagcuacagcugcaacuuccagaucgugagcaacaucgacaccaucugcaaccuggagggccccugcgacaccuuccacaacagaaucagcaucaaggccaugcagcagaacuacgccgugaagcugagcugccagaaggaccccggccccagcggcaccuucaagaucugcaacagagaguacaccgugguguuccacaccguggccaaggacgacaagaucgagaucaacgugggcgaccagaccagcuucaucaaggagaaggacgacagaugcaagaccuggcugugcagagugagagacgagggcaucagcgugaucuucgagcccaucaaggccuucuucggcagcuacuucagcaucuucuucuacaucaucaucaucgugguggugggcuuccugaucaucuacaucuucaugcccauguucaugaagcugaaggaggugcugaaggccaacgagaagcuguaccugcaggagaucaagcagaaguga

SEQ ID NO: 9216 - RNA, 4302 nt, Artificial Sequence
  derived and/or modified CDS sequence (opt4) from BUNV(MGD/S1/12060/WT)__KM507340.1__GP
augagaauccugauccugcugcuggccgugaccaagcuggccgugggcagccccguggugaccagaugcuuccacggcggccagcugaucgccgagagaaagagccagaccagcaucagcgaguucugcaucaaggacgacgugagcaugcugaagagcgagaucguguacaccaagaacgacaccggcaucuucggccacagcaagguguucagacacuggaccaucaccgacuggaaggccugcaaccccguggugaccgccggcggcagcaucaacgugaucgagguggacaagaaccugaaccuggugaccagaaacuacgugugcaccggcgacugcaccaucaccguggacaaggagaacgcccagaucaucuuccagaccgacagacugaaccacuucgaggugaccggcaccaccaucagcaccggcugguucaagagcaaggccagcgugacccuggacagaaccugcgagcacaucaaggugagcugcggcaagaagacccugcaguuccacgccugcuucaagcagcacaugagcugcgugagauuccugcacagaagcauccugcccggcagcauggccaucagcaucugccagaacaucgagcugaucaucaucaccauccuggcccugugcaucuucaucaucaugaucauccugaccaagaccuacaucugcuacgugcugauccccguguucaugcccaucgccuucgccuacggcugggccuacaacagaagcugcaagaagugcaccugcugcggccuggccuaccaccccuucaccaacugcggcagcuacugcgugugcggcagcaaguucgagaccagcgacagaaugagaaugcacagagagagcggccugugccagggcuucaagagccugagaguggccagaagacugugcaagagcaagggcagcagccugaucaucagcauccugcugagcgugcugauccugagcuucgugacccccaucgagggcacccugaccaacuaccccaccgaccagaaguacacccuggacgagaucgccgacgugcugcaggccaagacccacgaggacagcaccaaguacuacaucauccuguacaccagccuguucggcgccggccugaccaucaucuucgccggcguggcccugggccugaccaucauccuggaggugcugaccaagaucaacgugaucuucugcaacgagugcaacauguaccacagcaagaagagcaucaaguacgugggcgacuucaccaacaagugcggcuucugcaccugcggccugcuggaggaccccgagggcgugguggugcacaaggccaagaagagcugcaccuacagcuaccagaucagcugggugaagggcaucaugaucuucguggccuuccuguucgugauccagaacaccaucaucaugguggccgccgaggaggacugcugggagaacgaggagcugaaggaggacugcgugggcccccugaucgcccccaaggacugcaccgacaaggacagaaagaccuaccugagcgaggccagccugcuggccaccgccaagaagaucacccagguggacgccgagaacguggagauccugggcaagaccauggagagcgccaucagagugaucgagagacagaagaccuaccacagaaugcaccugcuggaggccguguuccugaacaagcacugcgacuacuacaagauguucgagcacaacagcggcuacagccaggugaaguggagaaugaugaucaagacccagcacuucgacaucugcgcccugcaggccagcagccccuucugcgcccagugcaucgccgacaacagcugcgcccagggcagcugggaguucgacacccacaugaacagcaccuacagcagcaagguggacaacuucaagcacgacuucagccuguuccugagaaucuucgaggccgccuuccccggcaccgccuacgugcaccugcugaccaacaucaaggagaagaagcccuaccaggccgugagcaugaucgagaagaucaagaagaaguuccccaacaacaagcugcugaucggcuaccuggacuucggcaaguaccugcugggccugagccacgccagcaccuacgagcugcagcagagccagcuggacaagcuguaccagcccaccgagcugaccagaagcggcggccagcagaccagccuggccagcagcguggugggccaggccaccaaggagugcaagaaguacaaggacgugagcugccugagccccagauucggcaucccccuggaggaccugaucagcugcggcgaccagcccaacuacaacaucuacaagaagcccaagaagguguacaaggcccacaacaaggaggagaccuggugcaucaacgaccagcacugccugguggacuucgugcccgccgaggccgacaccguggagaagcugaagcccaugaagugcuggcugguggaccccggcaagaacgacgacguguacagcaucgccaucaagaccugcagagugaucgacaagggcgugugcaccgugaacagccagaaguggaacaucaucaagugcgacagcgaccugcuguacuacagcgaccacgugcccggcgaggacaccggcaacgacaucggccacuacugcgugagcgccggcugcaagaccgacagauaccccaucaaccccgacguggugaccgacugcgugugggaguucaccagcagaagaagccaguacaucggcaagaucagcaugcagagccuggaggacuacaagaaggcccugaccgacagacugacccacacccuggagaccuacagcuucgccccccuggagaaccugccccacaucaagcccguguacaaguacaucaccgcccagggcguggagaacagcgacggcaucgagggcgccuucaucaccgccagcauccccgccgccggcggcaccagcaucggcuacaacgugagaagcaaggacggcuucccccugcuggaccugaucguguucgugaagagcgccgugaucaagagcaccuacaaccacaucuacgacaccggccccaccaucagcaucaacaccaagcacgacgagcacugcaccggccagugccccagcaacaucgagcacgaggccaacuggcugaccuucagccaggagagaaccagcagauggggcugcgaggaguucggcugccuggccgugaacaccggcugcguguucggcagcugccaggacgugaucagacccgagaccaagguguacagaaaggccguggacgagaucgugauccugaccgugugcaucaccuaccccggccacaccuucugcaccgagaucaacgccaucgagcccaagaucaccgaggagaucgagcugcaguucaagaccguggacaccaagacccugcccuacaucguggccgugaacaaccacaagcuguacagcggccagaucaacgaccugggcaccuucggccagaugugcggcaacgugcagaagaccaacagcagcauccugggcaccggcacccccaaguucgacuacaccugccacggcgccagcagaaaggacaucaucgugagaagaugcuacaacaacaacuucgacagcugcaagcugcugaaggaggagacccagcugaucuucaacgacgaccacgacaccaucaccguguacaacaccaaccaccugaucggcgagcuggccaucaagcugauccugggcgacauccaguacaagcuguucaccgagacccuggaccugcagaucgacgccaagugcgugggcugccccgacugcuucgagagcuacagcugcaacuuccagaucgugagcaacaucgacaccaucugcaaccuggagggccccugcgacaccuuccacaacagaaucagcaucaaggccaugcagcagaacuacgccgugaagcugagcugccagaaggaccccggccccagcggcaccuucaagaucugcaacagagaguacaccgugguguuccacaccguggccaaggacgacaagaucgagaucaacgugggcgaccagaccagcuucaucaaggagaaggacgacagaugcaagaccuggcugugcagagugagagacgagggcaucagcgugaucuucgagcccaucaaggccuucuucggcagcuacuucagcaucuucuucuacaucaucaucaucgugguggugggcuuccugaucaucuacaucuucaugcccauguucaugaagcugaaggaggugcugaaggccaacgagaagcuguaccugcaggagaucaagcagaaguga

SEQ ID NO: 9217 - RNA, 4308 nt, Artificial Sequence
  derived and/or modified CDS sequence (opt4) from Ab-BUNV(Cu20-XJ)__KJ710423.1__GP
auggccaucagcaucgugcugaugaucaucuucagcaccaccagcugccuggccagagccgcccccagcaucagcaagugcuuccaggacggcgugcugaucgccgagaagaagagcagcagcggcaucagcgaguucugcaucaaggacgacaucagcauccugaagagcgagaucaacuacagcaagaacgacaccggcaucuucaugcacagcaagguguucagacacuggaccguggccgacuggaagcagugccagcccauccccagcgccggcggcagcaucaacgugcuggagguggacaagaaccugaaccugguggccaagaacuacaugugcaccagacccugcgugaucaccaucgacaaggagaacgcccagcugcuguuccagaccgagcagcugaaccaguucgaggugaccggcaccaccaucagcaccggcugguucaagagcaagaccagcgugagccuggacaacaccugcgagcacaucaaggugaccugcggcaagaagagccugcaguuccacgccugcuucaagcagcacaugagcugcgugagauuccugcacagaagcgugcugcccggcuacauggccaacagcaucugccagaacaucgagcugaucaucaucaucacccugacccuggccaucuucaucuucaugugcaucaucaccagaaccuacaucugcuacaucaugcugccccuguucgcccccaucgccuacaucuacggcuggcuguacaacagaagcugcaagaagugcaucugcugcggccuggccuaccaccccuucaccaacugcggcagcuacugcgugugcggcagcagauucgagaccagcgacagaaugagacugcacagagagagcggccugugccagggcuucaagagccugagaguggccagaacccugugcaagagcaagggcagcagccuggugaucagcgugcugaccgccaugcugauccugagcuucgugaccccccuggaggccaucagcaccaacuaccccaccgacagaaaguacacccugaacgaggugaacgacaucgugcugggcaagggcaccgagaacgagcugaagaccagcauccuggcccuggugagcaucugcggcaucggcaucaucaucaucuucaucgcccugaccaugcugcuggacaucgugcuggaggccaucgccaagagaagcaccaucuucugcaccgagugcaaccugauccacgacaagaaggccaugaaguucgugggcgacuucaccaacaagugcggcuucugccccugcggcgagcuggaggaccccgagggccuggugauccacaccaccagaaagagcugcaccuacuacaucaagaucagaaaccugaagcugaucaugcugguguucagcaucgccauccugaugcagaacaccgccaugcuggugguggccgacgagaacugcuggaccaacaccgagaucaaggccgacugcgugggcccccugaucggccccaccaccugcaccaacaagggcagcaagaccuacaaggccguggcccaggagcuggugaccagcaacaagaucacccagcuggacgccgacaaguacacccugcugggcgacaccaucgagagcgcccugagcgccaucaccgagcagaagcacuacagcgccauccaccugcuggagaccaucuuccugaugaagcacugcgacuacuacaagguguacgagcacaacagcggcuacagccagaccaaguggagacugaucgccaagaccaacagcuucgacaucugcagcauccccagcacccccaacuucugcaagugccugagcgacagcagcugcagcaccagcacccugaacuucgccaccagcaugaacagcaccuacaccagcaaggccgaguacuucaaccacgacuucacccuguuccugaacaucuucgaggccgccuuccccggcagcgccaccgccuuccuguucaagaagaucaaggagaaggcccccuaccaggccuucgagaugaugggcaagaucgccaacaaguaccccaacaacaagcugcugguggugcugcugaaguacggccaguacauggugggccugagccacgccagcaccuaccagcugaagcaggaguggaucgccaagagccugagccuggugagaagcaccaagaccggccugaagauggccaugaccaacgccgagcccggccccgccaccaaggagugcagcgacgccaagaccaucgccugccugacccccaaguuccagguggaggugaacaaccugaugagcugcggcgccagccccaacuucaagaucuacaugaagagcggcgagcuguacaaggcccacgacagaaacagcguguggugccugaacgacaugcacugccugacccccuacacccccgccaacgccgagcugguggccaccaugaagaagauggagugcuggcaggacaaccccaagcagcccaccaacgacuacgccacccccagaagaagcugccagaugaaggacagaggccugugcaacgugggcgccgacaaguggaaggugaucaagugcgacgacgaccugauguucuacaccgacgcccuggagagccccgaccccgccgccgacaucggccaguacugcuucagcgagaagugccagaucgagagauaccccaucaaccccaccagccugaccaacugcgaguggcuguacagagccgugaagccccaguacaucaagagacugagccugcagaccaucgaggaguacaagaaggccaucaccgacaagcugacccacacccugcagcuguaccacuucgccccccuggagaaccugccccacaucagacccaccuacgaguacaucaccgcccagggcaccuacaccgccgacggcaucgagggcgccagcaucaucaccagcauccccgcccugagcggcaccagcgugggcuucaagaucaacgccaaggacggcaccgcccugcuggacaucgugguguacaucaagagcagcguggugaagagcguguacaaccacaucuacgacaccggccccaccaucaacaucaacagcaagcacgacgagcugugcaccggccagugccccaagagaauccccgccgaccccaacuggcugaccuucagccaggagagaaccagcagauggggcugcgaggaguucggcugccuggccaucaacaccggcugcguguacggcagcugccaggacgugaucagaaccgagaccaagguguacagaaaggccaacgaggagaccgugaugcugaccgugugcaucaccuaccccggccacaccuucugcaccgacgugaacgcccuggagcccaagaucaccgacgagcuggagcugcaguucaagaccaucgacaucaagagccugcccaaccugguggccaucaccaaccacaagcuguacaccggccagaucaacgaccugggcaccuucggccagaugugcggcaacgugcagaagaccaacaccagcauccugggcgccggcacccccaaguucgacuacaccugcuacagcgccagcagaaaggacaucaucaucagaagaugcuacaacaacaacuacgacagcugcagacugcugaagcaggagggcgaccugcuguucgacgacaaccacgagacccugaucguguacaacaacaagagacugaacggcgagcugaccaugaagcugcugcugggcgacauccaguacaagcuguacaccgagaacauggagcuggagcuggaggccaagugcgugggcugcgugggcugcuucgagagcuaccagugcaaccugcagaucaccagcagccuggacggcaacugcgccaucagcggccccugcgagaccuuccacgacagaauccagaucaagaccaccaagaaggacuacgcccugaagcuggccugcaccaaggaccccggcgacaaggccaccuucagagugugcggcaaggacuacgacuucaacuuccacaccguggugaagaacgacaagaucgaggugaacgugggcgacgagaccagcuacaucaaggagaaggacgccagaugcggcaccuggcugugcagagugagagacgagggccugagcgugaucuucgagccccugaagaacuucuucggcaacuaccugaacauguuccuguacauccugggcggcgugcugcugcuguuccugagccuguacaucaucaugcccgugugcgccagacugagagacgagcugaagaagaacgagaagcugcaccagauggagaugaagaagagauga

SEQ ID NO: 9218 - RNA, 4305 nt, Artificial Sequence
  derived and/or modified CDS sequence (opt4) from ANADV(EIV-13128Kam)__KT313718.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacaccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcaccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccaagugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaaucuacagcgugcuguucaccaccaucgacaagagcgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaccaucuacaucuuccugcccaugguguucaagcugaaggacauccugaagaagaacgagcugcuguaccugcaggagaugaaguacaaguga

SEQ ID NO: 9219 - RNA, 4305 nt, Artificial Sequence
  derived and/or modified CDS sequence (opt4) from ANADV(EIV-13130Kam)__KT313721.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccugaucguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccaagugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaccaucuacaucuuccugcccaugguguucaagcugaaggacauccugaagaagaacgagcugcuguaccugcaggagaugaaguacaaguga

SEQ ID NO: 9220 - RNA, 4305 nt, Artificial Sequence
  derived and/or modified CDS sequence (opt4) from ANADV(EIV-13395Mg)__KU159765.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacagagacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccaagugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaccaucuacaucuuccugcccaugguguucaagcugaaggacauccugaagaagaacgagcugcuguaccugcaggagaugaaguacaaguga

SEQ ID NO: 9221 - RNA, 4305 nt, Artificial Sequence
  derived and/or modified CDS sequence (opt4) from ANADV(EIV-16002Mg)__KT313724.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacgugggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaagcuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcagagagugcagaaacgccaagaagaucagcugcaucagccccagauucggcgugcccauggagaaccugaccgccugcggcgagagccccaacuacaagaucuacaagacccccgccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccaagugcgugggcugccccagcugcuucagcagcuacagcugcaacuucagaaucagcagcagcaucgacaccgugugcgccaucgacggccccugcaccguguuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaccaucuacaucuuccugcccaugguguucaagcugaaggacauccugaagaagaacgagcugcuguaccugcaggagaugaaguacaaguga

SEQ ID NO: 9222 - RNA, 4305 nt, Artificial Sequence
  derived and/or modified CDS sequence (opt4) from ANADV(EIV-16199Mg)__KT313730.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacgaggaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccugaucguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccagaugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaucaucuacaucuuccugcccaugguguucaagcugaaggacauccugaagaagaacgagcugcuguaccugcaggagaugaaguacaaguga

SEQ ID NO: 9223 - RNA, 4305 nt, Artificial Sequence
  derived and/or modified CDS sequence (opt4) from ANADV(EIV-16208Mg)__KT313733.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcagaaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccugaucugccugcugaucgcccagaacgccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaagcuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcaaguacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucaucgugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccaagugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaacagcguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaucaucuacaucuuccugcccaugguguucaagcugaaggacauccugaagaagaacgagcugcuguaccugcaggagaugaaguacaaguga

SEQ ID NO: 9224 - RNA, 4305 nt, Artificial Sequence
  derived and/or modified CDS sequence (opt4) from ANADV(EIV-16356Mg)__KT313736.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaagcuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucaccccccugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccaagugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaccaucuacaucuuccugcccaugguguucaagcugaaggacauccugaagaagaacgagcugcuguaccugcaggagaugaaguacaaguga

SEQ ID NO: 9225 - RNA, 4305 nt, Artificial Sequence
  derived and/or modified CDS sequence (opt4) from ANADV(EIV-17769Yak)__KT313739.1__GP
auguuccugauccuggugcugcugauccccuucuacaucaccgccacccccguggccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaaccugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacgugggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacagagacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcagagagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccaagugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucgacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaccaucuacaucuuccugcccaugguguucaagcugaaggacauccugaagaagaacgagcugcuguaccugcaggagaugaaguacaaguga

SEQ ID NO: 9226 - RNA, 4305 nt, Artificial Sequence
  derived and/or modified CDS sequence (opt4) from ANADV(EIV-18098Yak)__KT313742.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacgugggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcagagagugcagaaacgccaagaagaucagcugcaucagccccagauucggcgugcccauggagaaccugaccgccugcggcgagagccccaacuacaagaucuacaagacccccgccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccaagugcgugggcugccccagcugcuucagcagcuacagcugcaacuucagaaucagcagcagcaucgacaccgugugcgccaucgacggccccugcaccguguuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaccaucuacaucuuccugcccaugguguucaagcugaaggacauccugaagaagaacgagcugcuguaccugcaggagaugaaguacaaguga

SEQ ID NO: 9227 - RNA, 4305 nt, Artificial Sequence
  derived and/or modified CDS sequence (opt4) from ANADV(EIV-18136Yak)__KT313745.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaagcuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgugggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaugaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucggcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccagaugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaucaucuacaucuuccugcccaugguguucaagcugaaggacauccugaagaagaacgagcugcuguaccugcaggagaugaaguacaaguga

SEQ ID NO: 9228 - RNA, 4305 nt, Artificial Sequence
  derived and/or modified CDS sequence (opt4) from ANADV(EIV-18146Yak)__KT313748.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaucuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcagcugcacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucgugagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacgaggaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccugaucguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccagaugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaucaucuacaucuuccugcccaugguguucaagcugaaggacauccugaagaagaacgagcugcuguaccugcaggagaugaaguacaaguga

SEQ ID NO: 9229 - RNA, 4305 nt, Artificial Sequence
  derived and/or modified CDS sequence (opt4) from ANADV(EIV-18353Yak)__KT313751.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaucuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacgaggaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccugaucguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccagaugcgugggcugccccagcugcuucagcagcuacagcugcaacuucagaaucagcagcagcaucgacaccgugugcgccaucgacggccccugcaccaucuuccacaacagacugaucaucagccccaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaucaucuacaucuuccugcccaugguguucaagcugaaggacauccugaagaagaacgagcugcuguaccugcaggagaugaaguacaaguga

SEQ ID NO: 9230 - RNA, 4305 nt, Artificial Sequence
  derived and/or modified CDS sequence (opt4) from ANADV(EIV-18560Yak)__KT313754.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaucuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacgaggaggccaagaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacagagacuucgccggcgagaugaacaccaccuaccacagcaagagagacuucuucaagcacgacuucaaccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccugaucguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccagaugcgugggcugccccagcugcuucagcagcuacagcugcaacuucagaaucagcagcagcaucgacaccgugugcgccaucgacggccccugcaccaucuuccacaacagacugaucaucagccccaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaucaucuacaucuuccugcccaugguguucaagcugaaggacauccugaagaagaacgagcugcuguaccugcaggagaugaaguacaaguga

SEQ ID NO: 9231 - RNA, 4305 nt, Artificial Sequence
  derived and/or modified CDS sequence (opt4) from ANADV(EIV-18715Yak)__KT313757.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugccccugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagaagggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccugaucugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccaagaagcuggugggcaccagcagagugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucagccuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuacaagacccccaccagaaucuacaagagcaacaacaagggcgagaucuggugcgccggcgacgugcacugcuuccaggaguucacccccgugcugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcgugugggaguaccacagcagaaagagcagauacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccagaugcgugggcugccccagcugcuucagcagcuacagcugcaacuucagaaucagcagcagcaucgacaccgugugcgccaucgacggccccugcaccaucuuccacagcagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaucaucuacaucuuccugcccaugguguucaagcugaaggacauccugaagaagaacgagcugcuguaccugcaggagaugaaguacaaguga

SEQ ID NO: 9232 - RNA, 4305 nt, Artificial Sequence
  derived and/or modified CDS sequence (opt4) from ANADV(EIV-23263Tyum)__KT313760.1__GP
auguuccugauccuggugcugcugauccccuucuacaucaccgccacccccgugaccaccagaugcuuccacggcggccagcugaucgccgagagcaagagccugaccgccaucagcgaguucugccugaaggacgacgugagcaccgugaagagcgagaucaccuaccugaagaacgacaccggcaucuucgcccacagcaaggugcugagaaacuggaucaucaaggacuggaagaacugcaaccccgugcccaccgccggcggcagcaucaacgugaucgaggugaacgccgaccugagccugagcaccaagaccuacgugugcagcagagacugcaccaucaccguggacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcaccauggccgugagcaucugccagaacaucgagcugaucaucaucaccagccugacccugaucaucuucauccugauggugauccugaccaagaccuacaucugcuacgugcugaugccccuguucaugcccguggccuaccuguacggcugggccuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcgugcugauccugagcuucgugacccccaucgagggcacccugaccaacuaccccgagagcaagaaguacagccuggaggagaucgccgacgugaucgagggcuucaucgccgagagaggcaucaaggaguacaucgugcuguacaccagcaucuucggcgcccugcugcugcugaucgcccugaucaucaccgugagccugaacagaaucaccgaguaccugaccaaccugaacgugaucuacugccacgagugcagcauguaccacagcaagaagaacaucaaguacaucggcgacuucaccaacaagugcggcuucugcaccugcggcgagcuggaggaccaggagggccugaacaugcacaaggugagcaagaagugcaucuacagauaccagcugaccuggagcaaggugaucaugaccauccuggugugccugcugaucgcccagaacaccgugcugaucguggccgccaacgacgacugcugggccaagcagagccuggagaucgagugcgugggcccccugcagcagguggacgccugcgaggacaagagcagcagaagcuacaacggcgaggccagaaagcuggugggcaccagcaaggugaccgagcuggacgccggccaggugaaccugcugggccagaccaucgagagcgccaucaucgccaucagaaagcagagaaccuacgccaccaugcacuuccuggagagcguguuccugggcagacacugcgacuacuacaagguguucgagcacaacagcggcuacagccaggccaaguggagacugcuggccaagaccaaccacuucgacaucugcagcagacacagcacccaccacuucugcagaugcaugagcgacggcaccaagugcgagaacggcaacugggacuucgccggcgagaugaacaccaccuaccacagcaagagagacuucuucaagcacgacuucaagcuguucugcacccugcuggagaacgccuuccccggcaccaccgagagccuguacuaccagcugcugagcaagagaaacaccaccggcgccagcaagcugcugggcaagcugaucaccaaguucggcaacaacaaccuguucgugggcaucuggaaguucggccaguuccugcugagccugcccuacgugaacaacaccgagcugagcgcccugcagagcagcaagauccuggagagccccgagccccugcugagaagcgccagcggcagacaggagagccugagcagcgccacccccggcgaggccagcaaggagugcagaaacgccaagaagaucagcugcaucagccccagauucggcgugcccauggagaaccugaccgccugcggcgagagccccaacuacaagaucuucaagacccccaccagaaucuacaagagcaacaacaagggcgagaucuggugcgccggcgacgugcacugcuuccaggaguucacccccauccugcaggaggugguggacaagcugaagaagaugaccugcuuccugaccgagcccgaggccgaggaggacgccuucagcaucgccaucgccaugugcaagauccuggacaagggcgugugcaccaucaacagcgagagauggaacaucaucaagugcgacagcggccugauguacuacaccgaccagagagacggccaggacaccggcaacgacuucggcgaguacugcaucagccacaacugcaagaccgagagauuccccaucaaccccagcaucaucagcgacugcaucugggaguaccacagcagaaagagcagauacaucagcacccugaaccuggagagccuggaggaguucaagagagccaucagcgagaagcugagccacacccuggugguguaccaguucaagcccaccagcaaccugccccacaugaagcccguguacaaguacaucaccgcccagggcguggagaacagcgacggcaucgacagcgccuucaucaccgccagcaugcccgcccugagcggcaccagcaucggcuacaacgugaugagcaaggacaacuucccccuguucgacaucaucaucuucaucaagagcgccgugaucaagaccaccuacaaccacaucuacgacaccggccccaccaucggcaucaacgugaugcacgacgagcacugcaccggccagugccccaucgagaucccccacaaggagaacuggcugaccuucagccaggagagaaccagcagauggggcugcgaggaguucggcugccuggccaucaacaccggcugcguguucggcagcugccaggacaucaucagacccgagaccaagguguacagaaaggccaucgaggagagcgugcugcugaccgugugcgugaccuaccccggcaacaccuucugcaccgagaucaacgccaucgagcccaagaucaccgacgagcuggagcugcaguucaagaccguggacaccaagacccugcccaaccugcuggccgugcagaaccacaagcuguacagcggccagaucaacgaccugggcagcuucgcccagggcugcggcaacauccagaagaccaaccugagcgugaucggcaccggcaccgccaaguucgacuacaucugccacggcgccagcagaaaggacaucguggugagaagaugcuacaacaacaacuacgagagcugcaagcugcugaaggaggagcccagccugaucuucagcgacaaccacgagaccaucgagguggccaacaucagacaccugcugggcgagcugcaguucaagcugaugcugggcgaccugagauacaagagcuucgccgagaaccccgagcuggagaucgaggccagaugcgugggcugccccagcugcuucagcagcuacagcugcaacuucagaaucagcagcagcaucgacaccgugugcgccaucgacggccccugcaccaucuuccacaacagacugaucaucagcagcaccaagcaggacuacggcaucaagaugagcugcaaggagaagcccaaccccguggagaaguucaacaucugcaagagaguguacagcgugcuguucaccaccaucgacaagaacgacaagaucgagaucaacaccggcgaccagaccagcuucauccaggagaaggacgacagaugcaagaccuggcugugcagagugagagacgagggcaucagcgugaucuucgagcccaucaaggccuucuucggcagcuacuucagcaucgccuucuacguggugaucggcaucaucgcccuguucaucaucaucuacaucuuccugcccaugggcuucaagcugaaggacauccugaagaagaacgagcugcuguaccugcaggagaugaaguacaaguga

SEQ ID NO: 9233 - RNA, 4305 nt, Artificial Sequence
  derived and/or modified CDS sequence (opt4) from BATV(804992)__FJ436801.1__GP
augcugcugcugcuggugcugcugauccccugcugcgugagcgccagccccgugaucaccagaugcuuccacggcggccagcugaucgccgagagaaagagccaggccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugccccugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucgugguggagaagggcaucaaggaguacgugguguucuacaccagcaucuucggcgcccuguuccugcugauggcccugaucgugaucaucgcccugaacagagugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaaggugaucaugaugauccuggugugccugcugaucgcccagaacaccauccugaucguggccgccagcgacgacugcuggaccaagaagagccuggagauggagugcaucggcccccugcagcagguggacaccugcgacgacaagaccagcagaagcuacagcggcgaggccaagaagcuggugagagccagcaagaucagcgaccuggacgccgcccaggugggccugcugggcagcaccaucgagagcgccaucgccagcaucagaagacagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaucuaccagagcaagaaggacuucuucaagcacgacuucaagcuguucugcacccugguggagaacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaugagccugcccuacgugaacgagaccagccugagccccauccagcuggccaaggugcuggaggugaccgaccagcaccacagaagcgugagcggcagacaggagagccuggccagcgccacccccggcagcaagagcagcgagugcgaccacgccaagaaggugagcugcaucagccccagauucggcgcccccauggagggccugauggccugcggcaacagccccaacuacaagaucuacaagacccccgccaagcuguacaagagcaacaacaagggcgagguguggugcagcggcgacgugcacugcuuccaggagcugacccccgccagccaggagagcguggacagaaucaagcagaugaccugcuuccugaccgagcccgaggugaacgacgacguguucagcaucgccaucgccaugugcaaggugcaggacaagggcgugugcaccaucaacgaggacagauggaacaucaucaagugcgacagcggccugaucuacuacaccgaccagagagagggccaggacaccggcaacgacuucggcgaguacugccugagccacagcugcagaaucgagagauuccccaucaaccccgccaucaucagcgacugccugugggaguaccacagcagaaagagcaaguacaucaccagccuggaccuggagagccuggaggaguucaagagagccaucagcgagaagcugagccacacccuggugguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccaagcaggacuacggcaucaagaugagcugcaagaccaagcccggccugaccgaggaguuccagaucugcaagaagaccuacaccgugcuguucgccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacaucgugaucggcaucaucgugcuguuccuggugaucuacaucuuccugcccaugauguucaagcugagagacgugcugaagagaaacgaguaccuguaccugcaggagaucaagcacaaguga

SEQ ID NO: 9234 - RNA, 4305 nt, Artificial Sequence
  derived and/or modified CDS sequence (opt4) from BATV(8627-11)__FJ436799.1__GP
augcugcugcugcuggugcugcugauccccugcugcgugagcgccagccccgugaucaccagaugcuuccacggcggccagcugaucgccgagagaaagagccaggccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugccccugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucgugguggagaagggcaucaaggaguacgugguguucuacaccagcaucuucggcgcccuguuccugcugauggcccugaucgugaucaucgcccugaacagagugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaaggugaucaugaugauccuggugugccugcugaucgcccagaacaccauccugaucguggccgccagcgacgacugcuggaccaagagaagccuggagauggagugcaucggcccccugcagcagguggacaccugcgacgacaagaccagcagaagcuacagcggcgaggccaagaagcuggugagagccagcaagaucagcgaccuggacgccgcccaggugggccugcugggcagcaccaucgagagcgccaucgccagcaucagaagacagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgacuucaagcuguucugcacccugguggagaacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaugagccugcccuacgugaacgagaccagccugagccccacccagcuggccaaggugcuggaggugaccgaccagcaccacagaagcgugagcggcagacaggagagccuggccagcgccacccccggcagcaagagcagcgagugcgaccacgccaagaaggugagcugcaucagccccagauucggcgugcccauggagggccugauggccugcggcaacagccccaacuacaagaucuacaagacccccgccaagcuguacaagagcaacaacaagggcgagguguggugcagcggcaacgugcacugcuuccaggagcugaaccccgccagccaggagagcguggacagaaucaagcagaugaccugcuuccugaccgagcccgaggugaacgacgacguguucagcaucgccaucgccaugugcaaggugcaggacaagggcgugugcaccaucaacaaggacagauggaacaucaucaagugcgacagcggccugaucuacuacaccgaccagagagagggccaggacaccggcaacgacuucggcgaguacugccugagccacagcugcagaaucgagagauuccccaucaaccccgccaucaucagcgacugccugugggaguaccacagcagaaagagcaaguacaucaccagccuggaccuggagagccuggaggaguucaagagagccaucagcgagaagcugagccacacccuggugguguacaacuucaagcccaccgccaaccugccccacaucaagcccguguacgaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccagacaggacuacggcaucaagaugagcugcaagaccaagcccggccugaccgaggaguuccagaucugcaagaagaccuacaccgugcuguucgccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacaucgugaucggcaucaucgugcuguuccuggugaucuacaucuuccugcccaugauguucaagcugagagacgugcugaagagaaacgaguaccuguaccugcaggagaucaagcacaaguga

SEQ ID NO: 9235 - RNA, 4305 nt, Artificial Sequence
  derived and/or modified CDS sequence (opt4) from BATV(Chittoor/IG-20217)__JX846599.1__GP
augcugcugcugcuggugcugcugauccccugcugcgugagcgccagccccgugaucaccagaugcuuccacggcggccagcugaucgccgagagaaagagccaggccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugaugaucauccugaccaagaccuacaucugcuaccugcugaugccccuguucaugcccaucgccuacuucuacggcuggagcuacaacaagagcugcaagaagugccccugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucgugguggagaagggcaucaaggaguacgugguguucuacaccagcaucuucggcgcccuguuccugcugauggcccugaucgugaucaucgcccugaacagagugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaaggugaucaugaugauccuggugugccugcugaucgcccagaacaccauccugaucguggccgccagcgacgacugcuggaccaagaagagccuggagauggagugcaucggcccccugcagcagguggacaccugcgacgacaagaccagcagaagcuacagcggcgaggccaagaagcuggugagagccagcaagaucagcgaccuggacgccgcccaggugggccugcugggcagcaccaucgagagcgccaucgccagcaucagaagacagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagagagacuucuucgagcacgacuucaagcuguucugcacccugaucgagaacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaucagccugcccuacgugaacgagaccagccugagccccacccagcuggccaaggugcuggaggugaccgaccagcaccacagaagcaucagcggcagacaggagagccuggccagcgccacccccggcagcaagagcagcgagugcgaccacgccaagaaggccagcugcaucagccccagauucggcgugcccauggagggccugauggccugcggcaacagccccaacuacaagaucuacaagacccccgccaagcuguacaagagcaacaacaagggcgagguguggugcagcggcaacuuccacugcuuccaggagcugauccccgccagccaggagagcguggacagaaucaagcagaugaccugcuuccugaccgagcccgaggugaacgacgacguguucagcaucgccaucgccaugugcaaggugcaggacaagggcgugugcaccaucaacaaggacagauggaacgugaucaagugcgacagcggccugaucuacuacaccgaccagagagagggccaggacaccggcaacgacuucggcgaguacugccugagccacagcugcagaaucgagagauuccccaucaaccccgccaucaucagcgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaucaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccaagcaggacuacggcaucaagaugagcugcaagaccaagcccggccugaccgaggaguuccagaucugcaagaagaccuacaccgugcuguucgccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacaucgugaucggcaucaucgugcuguuccuggugaucuacaucuuccugcccaugauguucaagcugagagacgugcugaagagaaacgaguaccuguaccugcaggagaucaagcacaaguga

SEQ ID NO: 9236 - RNA, 4305 nt, Artificial Sequence
  derived and/or modified CDS sequence (opt4) from BATV(41.3)__KM507322.1__GP
augcugcuguuccugauccugcugauccccugcuacgccagcgccagccccguggugaccagaugcuuccacggcggccagcugaucgccgagagcagaagccccaccgccgugagcgaguucugccugaaggacgacgugagcaccaucaagagcgagaucaucuacgugaagaacgacaccggccuguucgcccacaacaaggugcugagaaacuggaucaucaaggacuggaagaacugcaaccccgugcccaccgccggcggcagcaucaacgugaucgaggugaacaccgaccugagccugagcaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacagcaccauccugcccggcaccauggccaccagcaucugccagaacaucgagcugaucaucaucaucagccugacccugcugaucuucauccugauggccauccugaccaagaccuacaucugcuaccugcugaugccccuguucaugcccaucgccuaccuguacggcuggagcuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucaucaccgagaagggcaucaaggaguacgugguguucuacaccagcaucuucggcggccuguuccugcugcuggcccugaucaucaucaucgcccugaacagagugaccgaguaccugaccaacaucaacguguucuacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaucauccuggugugccugcugaucgcccagaacaccauccugaucguggccgccagcaacgacugcugggccaagaagagccuggagauggagugcaucggcccccugcagcagguggagagcugcgacgacaaggccagcagaagcuacagcggcgaggccaagaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccuggccaagcacugcgacuacuacaagagcuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgacuucaagcuguucugcacccugcuggagaacgccuuccccggcaccaccgagagcuucuacuaccagaugcugcagaagaagaacaccaccggcguggugaagcugcuggacgagcugaccaagaaguucggcaacaacaacauguucgugggcaucuggaaguucggccaguaccugaugagccugcccuacaucaacgagaccagccugaccccccugcagcugagcaagauccuggaggccagcaaccagcaccacagaagcaucagcggcagacaggagagccuggccaacgccgccagcggcggcaagagcaaggagugcgaccacgccaagaaggugagcugcaucagccccagauucggcgugcccauggagggccugaucgccugcggcagcagccccaacuacaagaucuacaagaugcccaccaagcuguacaagagcaacaacaagggcgagguguggugcagcggcgacgugcacugcuuccaggagcugaaccccgccagccaggagagcguggacagaaucaagcagaugaccugcuuccugaccgagcccgagaccaacgaggacguguucagcaucgccaucagcaugugcaaggugcaggacaagggcgugugcaccaucaacgaggagagauggaacgugaucaagugcgacagcggccugaucuacuacaccgaccagagagacggccaggacaccggcaacgacuucggcgaguacugccugagccacaacugcagaaucgagagauuccccaucaaccccaccaucaucaacgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcaaggacaacuucccccuguucgacaucaucaucuucaucaagagcgccgugaucaaggccaccuacaaccacaucuacgacaccggccccaccaucggcaucaacgugaugcacgacgagcacugcaccggccagugccccaccgacaucccccacaaggagaacuggaucaccuucagccaggagagaaccagcagauggggcugcgaggaguucggcugccuggccgugaacaccggcugcguguucggcagcugccaggacaucaucagacccgagaccaagguguacagaaaggccaucgaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcagacugcugaaggaggagcagagccugauguucgccgacaaccacgagaccaucgacguggccaacgugagacaccugcugggcgaccugcaguucaagcugaugcugggcgaccugagauacaagagcuucgccgaggaccccgaccuggagaucgaggccaagugcgugggcugccccagcugcuucaccagcuacagcugcaacuucagaaucgugagcaacaucgacaccgugugcagcaucgagggccccugcaccaccuuccacaacagacugaugaucaccagcaccaagcaggacuacggcaucaagaugagcugcaagggcaagcccggcagcaccgaggaguuccagaucugcaagaagaccuacaccgugcuguucaccaccguggagaagaacgacaagaucgagaucaacaccggcgaccagaccagcuucauccaggagagagacgacagaugcaagaccuggcugugcagagugagagacgagggcaucagcgugaucuucgagcccaucagagccuucuucggcagcuacuucagcaucgccuucuacaucguggugggcaucaucgugcuguuccugaugaucuacaucuuccugcccauggccuucaagcugagagacgugcugaagagaaacgaguaccuguaccugcaggagaucaagcacaaguga

SEQ ID NO: 9237 - RNA, 4305 nt, Artificial Sequence
  derived and/or modified CDS sequence (opt4) from BATV(EIV-1217Astr)__KT313699.1__GP
augcugcuguuccugauccugcugauccccugcuacgccagcgccagccccguggugaccagaugcuuccacggcggccagcugaucgccgagagcagaagccccaccgccgugagcgaguucugccugaaggacgacgugagcaccaucaagagcgagaucaucuacgugaagaacgacaccggccuguucgcccacaacaaggugcugagaaacuggaucaucaaggacuggaagaacugcaaccccgugcccaccgccggcggcagcaucaacgugaucgaggugaacaccgaccugagccugagcaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugcugaucuucauccugauggccauccugaccaagaccuacaucugcuaccugcugaugccccuguucaugcccaucgccuaccuguacggcuggagcuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucgugaccgagaagggcaucaaggaguacgugguguucuacaccagcaucuucggcggccuguuccugcugcuggcccugaucaucaucaucgcccugaacagagugaccgaguaccugaccaacaucaacguguucuacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaucauccuggugugccugcugaucgcccagaacaccauccugaucguggccgccagcaacgacugcugggccaagaagagccuggagauggagugcaucggcccccugcagcagauggagagcugcgacgacaaggccagcagaagcuacagcggcgaggccaagaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccuggccaagcacugcgacuacuacaagagcuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucaagcacgacuucaagcuguucugcacccugcuggagaacgccuuccccggcaccaccgagagcuucuacuaccagaugcugcagaagaagaacaccaccggcguggugaagcugcuggacgagcugaccaagaaguucggcaacaacaacauguucgugggcaucuggaaguucggccaguaccugaugagccugcccuacaucaacgagaccagccugaccccccugcagcugagcaagauccuggaggccagcgaccagcaccacagaagcaucagcggcagacaggagagccuggccaacgccgccagcggcggcaagagcaaggagugcgaccacgccaagaaggugagcugcaucagccccagauucggcgugcccauggagggccugaucgccugcggcggcagccccaacuacaagaucuacaagaugcccaccaagcuguacaagagcaacaacaagggcgagguguggugcagcggcgacgugcacugcuuccaggagcugaaccccgcccugcaggagagcguggacagaaucaagcagaugaccugcuuccugaccgagcccgagaccaacgaggacguguucagcaucgccaucagcaugugcaaggugcaggacaagggcgugugcaccaucaacgaggagagauggaacgugaucaagugcgacagcggccugaucuacuacaccgaccagagagacggccaggacaccggcaacgacuucggcgaguacugccugagccacaacugcagaaucgagagauuccccaucaaccccaccaucaucaacgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcaaggacaacuucccccuguucgacaucaucaucuucaucaagagcgccgugaucaaggccaccuacaaccacaucuacgacaccggccccaccaucggcaucaacgugaugcacgacgagcacugcaccggccagugccccaccgacaucccccacaaggagaacuggaucaccuucagccaggagagaaccagcagauggggcugcgaggaguucggcugccuggccgugaacaccggcugcguguucggcagcugccaggacaucaucagacccgagaccaagguguacagaaaggccaucgaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcagacugcugaaggaggagcagagccugauguucgccgacaaccacgagaccaucgacguggccaacgugagacaccugcugggcgaccugcaguucaagcugaugcugggcgaccugagauacaagagcuucgccgaggaccccgaccuggagaucgaggccaagugcgugggcugccccagcugcuucaccagcuacagcugcaacuucagaaucgugagcaacaucgacaccgugugcagcaucgagggccccugcaccaccuuccacaacagacugaugaucaccagcaccaagcaggacuacggcaucaagaugagcugcaagggcaagcccggcagcaccgaggaguuccagaucugcaagaagaccuacaccgugcuguucaccaccguggagaagaacgacaagaucgagaucaacaccggcgaccagaccagcuucauccaggagagagacgacagaugcaagaccuggcugugcagagugagagacgagggcaucagcgugguguucgagcccaucagagccuucuucggcagcuacuucagcaucgccuucuacaucguggugggcaucaucgugcuguuccuggugaucuacaucuuccugcccauggccuucaagcugagagacgugcugaagagaaacgaguaccuguaccugcaggagaucaagcacaaguga

SEQ ID NO: 9238 - RNA, 4305 nt, Artificial Sequence
  derived and/or modified CDS sequence (opt4) from BATV(EIV-12497Bl)__KT313692.1__GP
augcugcuguuccugauccugcugauccccugcuacgccagcgccagccccguggugaccagaugcuuccacggcggccagcugaucgccgagagcagaagccccaccgccgugagcgaguucugccugaaggacgacgugagcaccaucaagagcgagaucaucuacgugaagaacgacaccggccuguucgcccacaacaaggugcugagaaacuggaucaucaaggacuggaagaacugcaaccccgugcccaccgccggcggcagcaucaacgugaucgaggugaacaccgaccugagccugagcaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaccagccugacccugcugaucuucauccugauggccauccugaccaagaccuacaucugcuaccugcugaugccccuguucaugcccaucgccuaccuguacggcuggagcuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucaucaccgagaagggcaucaaggaguacgugguguucuacaccagcaucuucggcggccuguuccugcugcuggcccugaucaucaucaucgcccugaacagagugaccgaguaccugaccaacaucaacguguucuacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaucauccuggugugccugcugaucgcccagaacaccauccugaucguggccgccagcaacgacugcugggccaagaagagccuggagauggagugcaucggcccccugcagcagguggagagcugcgacgacaaggccagcagaagcuacagcggcgaggccaagaagcuggugagagccagcaagaucagcgaccuggacgccgcccaggccggccugcugggcagcaccaucgagagcgccaucgccagcaucagaaagcagagaaccuaccccaccaugcaccugcuggagagcguguuccuggccaagcacugcgacuacuacaagagcuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgacuucaagcuguucugcacccugcuggagaacgccuuccccggcaccaccgagagcuucuacuaccagcugcugcagaagaagaacaccaccggcguggugaagcugcuggacgagcugaccaagaaguucggcaacaacaacauguucgugggcaucuggaaguucggccaguaccugaugagccugcccuacaucaacgagaccagccugaccccccugcagcugagcaagauccuggaggccagcgaccagcaccacagaagcaucagcggcagacaggagagccuggccagcgccgccagcggcggcaagagcaaggagugcgaccacgccaagaaggugagcugcaucagccccagauucagcgugcccauggagggccugaucgccugcggcagcagccccaacuacaagaucuacagaaugcccaccaagcuguacaagagcaacaacaagggcgagguguggugcagcggcgacgugcacugcuuccaggagcugaaccccgccagccaggagagcguggacagaaucaagcagaugaucugcuuccugaccgagcccgaggugaacgaggacguguucagcaucgccaucagcaugugcaaggugcaggacaagggcgugugcaccaucaacgaggagagauggaacgugaucaagugcgacagcggccugaucuacuacaccgaccagagagacggccaggacaccggcaacgacuucggcgaguacugccugagccacaacugcagaaucgagagauuccccaucaaccccaccaucaucaacgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccgugaucaaggccaccuacaaccacaucuacgacaccggccccaccaucggcaucaacgugaugcacgacgagcacugcaccggccagugccccaccgacaucccccacaaggagaacuggaucaccuucagccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcagacugcugaaggaggagcagagccugauguucgccgacaaccacgagaccaucgacguggccaacgugagacaccugcugggcgaccugcaguucaagcugaugcugggcgaccugagauacaagagcuucgccgaggaccccggccuggagaucgaggccaagugcgugggcugccccagcugcuucaccagcuacagcugcaacuucagaaucgugagcaacaucgacaccgugugcagcaucgagggccccugcaccaccuuccacaacagacugaugaucaccagcaccaagcaggacuacggcaucaagaugagcugcaagggcaagcccggcagcaccgaggaguuccagaucugcaagaagaccuacaccgugcuguucaccaccaucgagaagaacgacaagaucgagaucaacaccggcgaccagaccagcuucgugcaggagagagacgacagaugcaagaccuggcugugcagagugagagacgagggcaucagcgugaucuucgagcccaucagagccuucuucggcagcuacuucagcaucgccuucuacaucguggugggcaucaucgugcuguuccuggugaucuacaucuuccugcccauggccuucaagcugagagacgugcugaagagaaacgaguaccuguaccugcaggagaucaagcacaaguga

SEQ ID NO: 9239 - RNA, 4305 nt, Artificial Sequence
  derived and/or modified CDS sequence (opt4) from BATV(EIV-12845Ms)__KT313690.1__GP
augcugcuguuccugauccugcugauccccugcuacgccagcgccagccccguggugaccagaugcuuccacggcggccagcugaucgccgagaacagaagccccaccgccgugagcgaguucugccugaaggacgacgugagcaccaucaagagcgagaucaucuacgugaagaacgacaccggccuguucgcccacaacaaggugcugagaaacuggaucaucaaggacuggaagaacugcaaccccgugcccaccgccggcggcagcaucaacgugaucgaggugaacaccgaccugagccugagcaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacagcaccauccugcccggcaccauggccaccagcaucugccagaacaucgagcugaucaucaucaucagccugacccugcugaucuucauccugauggccauccugaccaagaccuacaucugcuaccugcugaugccccuguucaugcccaucgccuaccuguacggcuggagcuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucaucaccgagaagggcaucaaggaguacgugguguucuacaccagcaucuucggcggccuguuccugcugcuggcccugaucaucaucaucgcccugaacagagugaccgaguaccugaccaacaucaacguguucuacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaucauccuggugugccugcugaucgcccagaacaccauccugaucguggccgccagcaacgacugcugggccaagaagagccuggagauggagugcaucggcccccugcagcagguggagagcugcgacgacaaggccagcagaagcuacagcggcgaggccaagaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccuggccaagcacugcgacuacuacaagagcuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgacuucaagcuguucugcacccugcuggagaacgccuuccccggcaccaccgagagcuucuacuaccagaugcugcagaagaagaacaccaccggcguggugaagcugcuggacgagcugaccaagaaguucggcaacaacaacauguucgugggcaucuggaaguucggccaguaccugaugagccugcccuacaucaacgagaccagccugaccccccugcagcugagcaagauccuggaggccagcgaccagcaccacagaagcaucagcggcagacaggagagccuggccaacgccgccagcggcagcaagagcaaggagugcgaccacgccaagaaggugagcugcaucagccccagauucggcgugcccauggagggccugaucgccugcggcagcagccccaacuacaagaucuacaagaugcccaccaagcuguacaagagcaacaacaagggcgagguguggugcagcggcgacgugcacugcuuccaggagcugaaccccgccagccaggagagcguggacagaaucaagcagaugaccugcuuccugaccgagcccgagaccaacgaggacguguucagcaucgccaucagcaugugcaaggugcaggacaagggcgugugcaccaucaacgaggagagauggaacgugaucaagugcgacagcggccugaucuacuacaccgaccagagagacggccaggacaccggcaacgacuucggcgaguacugccugagccacaacugcagaaucgagagauuccccaucaaccccaccaucaucaacgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcaaggacaacuucccccuguucgacaucaucaucuucaucaagagcgccgugaucaaggccaccuacaaccacaucuacgacaccggccccaccaucggcaucaacgugaugcacgacgagcacugcaccggccagugccccaccgacaucccccacaaggagaacuggaucaccuucagccaggagagaaccagcagauggggcugcgaggaguucggcugccuggccgugaacaccggcugcguguucggcagcugccaggacaucaucagacccgagaccaagguguacagaaaggccaucgaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaacuacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcagacugcugaaggaggagcagagccugauguucgccgacaaccacgagaccaucgacguggccaacgugagacaccugcugggcgaccugcaguucaagcugaugcugggcgaccugagauacaagagcuucgccgaggaccccgaccuggagaucgaggccaagugcgugggcugccccagcugcuucaccagcuacagcugcaacuucagaaucgugagcaacaucgacaccgugugcagcaucgagggccccugcaccaccuuccacaacagacugaugaucaccagcaccaagcaggacuacggcaucaagaugagcugcaagggcaagcccggcagcaccgaggaguuccagaucugcaagaagaccuacaccgugcuguucaccaccguggagaagaacgacaagaucgagaucaacaccggcgaccagaccagcuucauccaggagagagacgacagaugcaagaccuggcugugcagagugagagacgagggcaucagcgugaucuucgagcccaucagagccuucuucggcagcuacuucagcaucgccuucuacaucguggugggcaucaucgugcuguuccuggugaucuacaucuuccugcccauggccuucaagcugagagacgugcugaagagaaacgaguaccuguaccugcaggagaucaagcacaaguga

SEQ ID NO: 9240 - RNA, 4305 nt, Artificial Sequence
  derived and/or modified CDS sequence (opt4) from BATV(EIV-2077Astr)__KT313702.1__GP
augcugcuguuccugauccugcugauccccugcuacgccagcgccagccccguggugaccagaugcuuccacggcggccagcugaucgccgagagcagaagccccaccgccgugagcgaguucugccugaaggacgacgugagcaccaucaagagcgagaucaucuacgugaagaacgacaccggccuguucgcccacaacaaggugcugagaaacuggaucaucaaggacuggaagaacugcaaccccgugcccaccgccggcggcagcaucaacgugaucgaggugaacaccgaccugagccugagcaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugcugaucuucauccugauggccauccugaccaagaccuacaucugcuaccugcugaugccccuguucaugcccaucgccuaccuguacggcuggagcuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucgugaccgagaagggcaucaaggaguacgugguguucuacaccagcaucuucggcggccuguuccugcugcuggcccugaucaucaucaucgcccugaacagagugaccgaguaccugaccaacaucaacguguucuacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaucauccuggugugccugcugaucgcccagaacaccauccugaucguggccgccagcaacgacugcugggccaagaagagccuggagauggagugcaucggcccccugcagcagauggagagcugcgacgacaaggccagcagaagcuacagcggcgaggccaagaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccuggccaagcacugcgacuacuacaagagcuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgacuucaagcuguucugcacccugcuggagaacgccuuccccggcaccaccgagagcuucuacuaccagaugcugcagaagaagaacaccaccggcguggugaagcugcuggacgagcugaccaagaaguucggcaacaacaacauguucgugggcaucuggaaguucggccaguaccugaugagccugcccuacaucaacgagaccagccugaccccccugcagcugagcaagauccuggaggccagcgaccagcaccacagaagcaucagcggcagacaggagagccuggccaacgccgccagcggcggcaagagcaaggagugcgaccacgccaagaaggugagcugcaucagccccagauucggcgugcccauggagggccugaucgccugcggcggcagccccaacuacaagaucuacaagaugcccaccaagcuguacaagagcaacaacaagggcgagguguggugcagcggcgacgugcacugcuuccaggagcugaaccccgcccugcaggagagcguggacagaaucaagcagaugaccugcuuccugaccgagcccgagaccaacgaggacguguucagcaucgccaucagcaugugcaaggugcaggacaagggcgugugcaccaucaacgaggagagauggaacgugaucaagugcgacagcggccugaucuacuacaccgaccagagagacggccaggacaccggcaacgacuucggcgaguacugccugagccacaacugcagaaucgagagauuccccaucaaccccaccaucaucaacgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcaaggacaacuucccccuguucgacaucaucaucuucaucaagagcgccgugaucaaggccaccuacaaccacaucuacgacaccggccccaccaucggcaucaacgugaugcacgacgagcacugcaccggccagugccccaccgacaucccccacaaggagaacuggaucaccuucagccaggagagaaccagcagauggggcugcgaggaguucggcugccuggccgugaacaccggcugcguguucggcagcugccaggacaucaucagacccgagaccaagguguacagaaaggccaucgaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcagacugcugaaggaggagcagagccugauguucgccgacaaccacgagaccaucgacguggccaacgugagacaccugcugggcgaccugcaguucaagcugaugcugggcgaccugagauacaagagcuucgccgaggaccccgaccuggagaucgaggccaagugcgugggcugccccagcugcuucaccagcuacagcugcaacuucagaaucgugagcaacaucgacaccgugugcagcaucgagggccccugcaccaccuuccacaacagacugaugaucaccagcaccaagcaggacuacggcaucaagaugagcugcaagggcaagcccggcagcaccgaggaguuccagaucugcaagaagaccuacaccgugcuguucaccaccguggagaagaacgacaagaucgagaucaacaccggcgaccagaccagcuucauccaggagagagacgacagaugcaagaccuggcugugcagagugagagacgagggcaucagcgugguguucgagcccaucagagccuucuucggcagcuacuucagcaucgccuucuacaucguggugggcaucaucgugcuguuccuggugaucuacaucuuccugcccauggccuucaagcugagagacgugcugaagagaaacgaguaccuguaccugcaggagaucaagcacaaguga

SEQ ID NO: 9241 - RNA, 4305 nt, Artificial Sequence
  derived and/or modified CDS sequence (opt4) from BATV(Italy-2009)__KC168047.1__GP
augcugcuguuccugauccugcugauccccugcuacgccagcgccagccccguggugaccagaugcuuccacggcggccagcugaucgccgagagcagaagccccaccgccgugagcgaguucugccugaaggacgacgugagcaccaucaagagcgagaucaucuacgugaagaacgacaccggccuguucgcccacaacaaggugcugagaaacuggaucaucaaggacuggaagaacugcaaccccgugcccaccgccggcggcagcaucaacgugaucgaggugaacaccgaccugagccugagcaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacagcaccauccugcccggcaccauggccaccagcaucugccagaacaucgagcugaucaucaucaucagccugacccugcugaucuucauccugauggccauccugaccaagaccuacaucugcuaccugcugaugccccuguucaugcccaucgccuaccuguacggcuggagcuacaacagaagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucaucaccgagaagggcaucaaggaguacgugguguucuacaccagcaucuucggcggccuguuccugcugcuggcccugaucaucaucaucgcccugaacagagugaccgaguaccugaccaacaucaacguguucuacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaucauccuggugugccugcugaucgcccagaacaccauccugaucguggccgccagcaacgacugcugggccaagaagagccuggagauggagugcaucggcccccugcagagaguggagagcugcgacgacaaggccagcagaagcuacagcggcgaggccaagaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccuggccaagcacugcgacuacuacaagagcuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgacuucaagcuguucugcacccugcuggagaacgccuuccccggcaccaccgagagcuucuacuaccagaugcugcagaagaagaacaccaccggcguggugaagcugcuggacgagcugaccaagaaguucggcaacaacaacauguucgugggcaucuggaaguucggccaguaccugaugagccugcccuacaucaacgagaccagccugaccccccugcagcugagcaagauccuggaggccagcaaccagcaccacagaagcaucagcggcagacaggagagccuggccaacgccgccagcggcggcaagagcaaggagugcgacaacgccaagaaggugagcugcaucagccccagauucggcgugcccauggagggccugaucgccugcggcagcagccccaacuacaagaucuacaagaugcccaccaagcuguacaagagcaacaacaagggcgagguguggugcagcggcgacgugcacugcuuccaggagcugaaccccgccagccaggagagcguggacagaaucaagcagaugaccugcuuccugaccgagcccgagaccaacgaggacguguucagcaucgccaucagcaugugcaaggugagagacaagggcgugugcaccaucaacgaggagagauggaacgugaucaagugcgacagcggccugaucuacuacaccgaccagagagacggccaggacaccggcaacgacuucggcgaguacugccugagccacaacugcagaaucgagagauuccccaucaaccccgccaucaucaacgacugccugugggaguaccacagcagaagaagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcaaggacaacuucccccuguucgacaucaucaucuucaucaagagcgccgugaucaaggccaccuacaaccacaucuacgacaccggccccaccaucggcaucaacgugaugcacgacgagcacugcaccggccagugccccaccgacaucccccacaaggagaacuggaucaccuucagccaggagagaaccagcagauggggcugcgaggaguucggcugccuggccgugaacaccggcugcguguucggcagcugccaggacaucaucagacccgagaccaagguguacagaaaggccaucgaggagaacgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcagacugcugaaggaggagcagagccugauguucgccgacaaccacgagaccaucgacguggccaacgugagacaccugcugggcgaccugcaguucaagcugaugcugggcgaccugagauacaagagcuucgccgaggaccccgaccuggagaucgaggccaagugcgugggcugccccagcugcuucaccagcuacagcugcaacuucagaaucgugagcaacaucgacaccgugugcagcaucgagggccccugcaccaccuuccacaacagacugaugaucaccagcaccaagcaggacuacggcaucaagaugagcugcaagggcaagcccggcagcaccgaggaguuccagaucugcaagaagaccuacaccgugcuguucaccaccguggagaagaacgacaagaucgagaucaacaccggcgaccagaccagcuucauccaggagagagacgacagaugcaagaccuggcugugcagagugagagacgagggcaucagcgugaucuucgagcccaucagagccuucuucggcagcuacuucagcaucgccuucuacaucguggugggcaucaucgugcuguuccugaugaucuacaucuuccugcccauggccuucaagcugagagacgugcugaagagaaacgaguaccuguaccugcaggagaucaagcacaaguga

SEQ ID NO: 9242 - RNA, 4305 nt, Artificial Sequence
  derived and/or modified CDS sequence (opt4) from BATV(MM2222)__AB257763.1__GP
augcugcugcugcuggugcugcugaucagcugcugcgugagcgccagccccgugaucaccagaugcuuccacggcggccagcugaucgccgagagaaagagccagaccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucguguuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugccccugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacaaccuggaggagaucgccgacgugcuggagggcuucgugguggagaagggcaucaaggaguacgugguguucuacaccagcaucuucggcgcccuguuccugcugauggcccugaucgugaucaucgcccugaacagagugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaugauccuggugugccugcugaucgcccagaacaccauccugaucguggccgccagcgacgacugcuggaccaagaagagccuggagauggagugcaucggcccccugcagcagguggacaccugcgaggacaagaccagcagaagcuacagcggcgaggccaagaagcuggugagagccagcaagaucagcgaccuggacgccgcccaggugggccugcugggcagcaccaucgagagcgccaucgccagcaucagaagacagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaucuaccagagcaagagagacuucuucaagcacgacuucaagcuguucugcacccugaucgaggacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaugagccugcccuacgugaacgagaccagccugagccccacccagcuggccaaggugcuggaggugaccgaccaccaccacagaagcaucagcggcagacaggagagccuggccagcgccaccagcggcagcaagagcagcgagugcgaccacgccaagaaggugagcugcaucagccccagauucggcgugcccauggagggccugaucgccugcggcaacagccccaacuacaagaucuacaagacccccgccaagcuguacaagagcaacaacaagggcgagguguggugcagcggcgacgugcacugcuuccaggagcugauccccgccagccaggagagcguggacagaaucaagcagaugaccugcuuccugaccgagcccgaggugaacgacgacguguucagcaucgccaucagcaugugcaaggugcaggacaagggcgugugcaccaucaacgaggacagauggaacgugaucaagugcgacagcggccugaucuacuacaccgaccagagagagggccaggacaccggcaacgacuucggcgaguacugccugagccacagcugcagaaucgagagauuccccaucaaccccaccaucaucagcgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccaagcaggacuacggcaucaagaugagcugcaagaccaagcccggccccaucgaggaguuccagaucugcaagaagaccuacaccauccuguucaccaccguggagaagaacgacaagaucgagaucagcaccggcgaccagaccagcuucauccaggagaaggacgacagaugcaagaccuggcugugcagagugagagacgagggcaucagcgugaucuucgagcccaucagagccuucuucggcagcuacuucagcaucgccuucuacaucgugaucggcaucaucgugcuguuccuggugaucuacaucuuccugcccaugauguucaagcugagagacgugcugaagagaaacgaguaccuguaccugcaggagaucaagcacaaguga

SEQ ID NO: 9243 - RNA, 4305 nt, Artificial Sequence
  derived and/or modified CDS sequence (opt4) from BATV(MM2222)__AY772534.1__GP
augcugcugcugcuggugcugcugaucagcugcugcgugagcgccagccccgugaucaccagaugcuuccacggcggccagcugaucgccgagagaaagagccagaccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucguguuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugccccugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacaaccuggaggagaucgccgacgugcuggagggcuucgugguggagaagggcaucaaggaguacgugguguucuacaccagcaucuucggcgcccuguuccugcugauggcccugaucgugaucaucgcccugaacagagugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaugauccuggugugccugcugaucgcccagaacaccauccugaucguggccgccagcgacgacugcuggaccaagaagagccuggagauggagugcaucggcccccugcagcagguggacaccugcgaggacaagaccagcagaagcuacagcggcgaggccaagaagcuggugagagccagcaagaucagcgaccuggacgccgcccaggugggccugcugggcagcaccaucgagagcgccaucgccagcaucagaagacagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaucuaccagagcaagagagacuucuucaagcacgacuucaagcuguucugcacccugaucgaggacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaugagccugcccuacgugaacgagaccagccugagccccacccagcuggccaaggugcuggaggugaccgaccaccaccacagaagcaucagcggcagacaggagagccuggccagcgccaccagcggcagcaagagcagcgagugcgaccacgccaagaaggugagcugcaucagccccagauucggcgugcccauggagggccugaucgccugcggcaacagccccaacuacaagaucuacaagacccccgccaagcuguacaagagcaacaacaagggcgagguguggugcagcggcgacgugcacugcuuccaggagcugauccccgccagccaggagagcguggacagaaucaagcagaugaccugcuuccugaccgagcccgaggugaacgacgacguguucagcaucgccaucagcaugugcaaggugcaggacaagggcgugugcaccaucagcgaggacagauggaacgugaucaagugcgacagcggccugaucuacuacaccgaccagagagagggccaggacaccggcaacgacuucggcgaguacugccugagccacagcugcagaaucgagagauuccccaucaaccccaccaucaucagcgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccaagcaggacuacggcaucaagaugagcugcaagaccaagcccggccccaucgaggaguuccagaucugcaagaagaccuacaccauccuguucaccaccguggagaagaacgacaagaucgagaucagcaccggcgaccagaccagcuucauccaggagaaggacgacagaugcaagaccuggcugugcagagugagagacgagggcaucagcgugaucuucgagcccaucagagccuucuucggcagcuacuucagcaucgccuucuacaucgugaucggcaucaucgugcuguuccuggugaucuacaucuuccugcccaugauguucaagcugagagacgugcugaagagaaacgaguaccuguaccugcaggagaucaagcacaaguga

SEQ ID NO: 9244 - RNA, 4305 nt, Artificial Sequence
  derived and/or modified CDS sequence (opt4) from BATV(MM2222)__JX846596.1__GP
augcugcugcugcuggugcugcugaucagcugcugcgugagcgccagccccgugaucaccagaugcuuccacggcggccagcugaucgccgagagaaagagccagaccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucguguuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugccccugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacaaccuggaggagaucgccgacgugcuggagggcuucgugguggagaagggcaucaaggaguacgugguguucuacaccagcaucuucggcgcccuguuccugcugauggcccugaucgugaucaucgcccugaacagagugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaugauccuggugugccugcugaucgcccagaacaccauccugaucguggccgccagcgacgacugcuggaccaagaagagccuggagauggagugcaucggcccccugcagcagguggacaccugcgaggacaagaccagcagaagcuacagcggcgaggccaagaagcuggugagagccagcaagaucagcgaccuggacgccgcccaggugggccugcugggcagcaccaucgagagcgccaucgccagcaucagaagacagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaucuaccagagcaagagagacuucuucaagcacgacuucaagcuguucugcacccugaucgaggacgccuuccccggcaccaccgagagccuguucuacgagaugcugagcaagaagaacaccaccggcaucaccgagcugcuggacaagcugaccaagaaguucggcaacaacaacauguucgugggcaucuggaaguucggccaguaccugaugagccugcccuacgugaacgagaccagccugagccccacccagcuggccaaggugcuggaggugaccgaccaccaccacagaagcaucagcggcagacaggagagccuggccagcgccaccagcggcagcaagagcagcgagugcgaccacgccaagaaggugagcugcaucagccccagauucggcgugcccauggagggccugaucgccugcggcaacagccccaacuacaagaucuacaagacccccgccaagcuguacaagagcaacaacaagggcgagguguggugcagcggcgacgugcacugcuuccaggagcugauccccgccagccaggagagcguggacagaaucaagcagaugaccugcuuccugaccgagcccgaggugaacgacgacguguucagcaucgccaucagcaugugcaaggugcaggacaagggcgugugcaccaucaacgaggacagauggaacgugaucaagugcgacagcggccugaucuacuacaccgaccagagagagggccaggacaccggcaacgacuucggcgaguacugccugagccacagcugcagaaucgagagauuccccaucaaccccaccaucaucagcgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccaagcaggacuacggcaucaagaugagcugcaagaccaagcccggccccaucgaggaguuccagaucugcaagaagaccuacaccauccuguucaccaccguggagaagaacgacaagaucgagaucagcaccggcgaccagaccagcuucauccaggagaaggacgacagaugcaagaccuggcugugcagagugagagacgagggcaucagcgugaucuucgagcccaucagagccuucuucggcagcuacuucagcaucgccuucuacaucgugaucggcaucaucgugcuguuccuggugaucuacaucuuccugcccaugauguucaagcugagagacgugcugaagagaaacgaguaccuguaccugcaggagaucaagcacaaguga

SEQ ID NO: 9245 - RNA, 4305 nt, Artificial Sequence
  derived and/or modified CDS sequence (opt4) from BATV(MS50)__JX846605.1__GP
augaagaugcugacccugaucaucaucgugagcugcuggguggccacccugcagaacccccugaucagcagaugcuuccacggcggccagcugaucgccgagaagaagagccugaccagcaucagcgaguucugcaucaaggacgacgugagcaugcugaagagcgaggugaucuaccagaagaacgacaccggcaucuacggccacagcaagguguucagacacuggaccaucgccgacuggaaguacugcaaccccgugcccaccgccggcggcagcaucaacgugaucgagcuggacaagaaccugaaccugaucgccaagaacuacgugugcaccagagacugcaccaucaccguggacaaggagaacgcccagaucguguuccagaccgacaagcugaaccacuucgaggugaccggcaccaccaucagcaccggcugguucaagaccaaggccagcguggcccuggacagaaccugcgagcacaucaaggugagcugcggcaagaagacccugcaguuccacgccugcuucaagcagcacaugagcugcgugagauuccugcacagaagcaugcugcccggcagcauggccaacagcaucugccagaacaucgagcugaucaucaucaucacccugacccuggugaucuucauccugaugcugaucgccaccagauucuacaucugcuaccugcugauccccguguucaugcccaucgccuacgccuacggcugggccuacaacagaagcugcaagaagugcagcugcugcggccuggccuaccaccccuucaccaacugcggcagcuacugcgugugcggcgccagauucgagaccagcgacagaaugagacugcacagagagagcggccugugccagggcuucaagagccugagaauggccagaagacugugcaagagcaagggcagcagccuggugaucagcauccugcuggccacccugauccugagcuucgugacccccaucgagggcaccaugaccaacuaccccaccaacgagaaguacagccuggacgagaucgccgacgugcugaaguggaaggagcaggagagcgaguacaaguacuacgccauccuguacgccagcaucaucggcgccugcuucaccgugcuguucgccggcaccgcccuggcccugaacaucgugcuggagcugcugaccaagaucaacgugaucuacugcgaggagugcagcauguaccacagcaagagcaacaucaaguacaucggcgacuucaccaacaagugcggcuucugcaccugcggccugcuggaggaccccgacggcgugguggugcacaaggugaagagaagcugcaccuaccaguacaagcugaccugggugaagaccaucaugaucgugcugagcauccuguuccugcugcagaacaucaucgugaucguggccgccgacagcgacugcuggaccaacgaggagcugaagcccgagugcgugggcccccugaucgcccccgccgacugcaccgagaaggacaagaagaccuaccugaccgaggccgccgcccuggugaagaccaagaagaucagccagguggacgccgacaacguggagauccugggcaagaccaucgagagcgccaucaaggccaucgagaagcagaagaccuaccacagaaugcaccugcuggaggccguguuccugaacaagcacugcgacuacuacaagcuguucgagcacaacagcggcuacagccaggugaaguggagaaugcuggccaagacccagcacuucgacaucugcgccuucgccaaggagagcaaguucugcaagugcauggccggcggcgccugcgccgaggacagcugggacuucgacaccaccaugaacagcaccuacaccagcaagggcgacaacuucaagcacgacaugagccuguuccugaagaucuucgaggccgccuuccccggcaccagcuacguguacaugcugaacaagaucaaggagaagaagcccuaccagagcgugaccaugaucgacaagaucaagaccaaguaccccaacaacaagaugcugguggccuaccuggaguucggcaagugccugaugggcgugggccacgccagcaccuucgagcugcagcagagccagcuggagagacuguaccagcccgccgagcugagcagaagcgugggccagcugaccagccugagcaacgcccaggugggcaccaucaccaaggagugcagcaaguacaaggacaucagcugccugagccccagauucggcauccccauggagaacaugguggccugcggcgacagccccaacuacaagaucuacaagaagcccaucaagguguacaaggcccacgacagaguggagaccuggugcaucaaggaccagcacugccugguggacuacacccccgccgaggccgacguggugaagaagcugaagaccaugaagugcuggcugaacgaccccggcaccgagaccgacgccuacaccaccgccaucaagagcugcagaaucauggacaagggcgugugcaccgugaacggccagaaguggagcaucaucaagugcgacagcgaccugcuguacuacaccgaccacaucgagggcgaggacaccggcaacgacaucggccacuacugcaucagcgugggcugcaagaccgacagauaccccaucaaccccgacaucgugaccgacugcaccugggaguucaagagcagaaagagcagcuacaucggcaagaucagcaugcagagccuggaggacuacaagaaggcccugaccgacaagcugacccacacccuggagaccuacagcuucgcccccaccgccgaccugccccacaucaagcccaucuacaaguacaucaccgcccagggcguggagaacagcgacggcaucgagggcgccuacaucaccgccaccauccccgcccugggcggcaccagcaucggcuacagcgugcagagcaaggacggcuucccccugcuggaccugaucaucuacaucaaggccgccgugaucagaagcaccuacauccaccuguacgacaccggccccaccaucagcaucaacaccaagcacgacgagaagugcaccggccagugccccgccgagaucgagcacgaggccaacuggcugaccuucagccaggagagaaccagcagauggggcugcgaggaguucggcugccuggccaucaacaccggcugcguguucggcagcugccaggacgugaucagacccgagaccaagguguacagaaagagcguggaggaggagguggugcugaccgugugcaucaacuaccccggcaacaccuucugcaccgagaucaacgccaucgagcccaagaucaccgaggagguggagcugcaguucaagaccguggacaccaagacccugcccacccugcuggccgugaccaaccacaagcuguucagcggccagaucaacgaccugggcaccuucggccagaugugcggcaacgugcagaagaccaacagcagcauccugggcagcggcacccccaaguucgacuacaccugccacggcgccagcagaaaggacaucaucgugagaaagugcuacaacaacaacuacgacagcugcaagcugcugaaggaggagaagcagcugguguucaacgacgaccacgagaccaucaccguggugaacaacagacaccuggugggcgagcuggccaucaagcugauccugggcgacauccaguacaagcuguucaccgagaagcuggaccugcagaucgacgccaagugcgugggcugccccgacugcuucgagagcuacgccugcaacuuccagaucgugagcaacaucgacaccgugugcgccaucaacggccccugcgacaucuuccacaacagaaucagcaucagaagcacccagcagaacuacggcgugaagaugagcugcaagagaacccccgaccagaacgagaaguucgugaucugcggcagagaguacagcguguucuuccacaccgugcagaagaacgacaagaucgagaucaacaccggcgaccagaccagcuacaucaaggagauggacaccagaugcaagaccuggcugugcagagugagagacgagggccugagcgugaucuucgagcccaucaaggccuucuucggcagcuacuucagcaucgccuucuacaucgugcuguucaucaucaucgccuuccuggugaucuacaucuucaugcccauguucaugaagcugagagacauccugaagcagaacgagaagcuguaccugcaggagaucaagcagaaguga

SEQ ID NO: 9246 - RNA, 4305 nt, Artificial Sequence
  derived and/or modified CDS sequence (opt4) from BATV(NM/12)__KJ187039.1__GP
augcugcugcugcuggugcugcugauccccugcugcgugagcgccagccccgccaucaccagaugcuuccacggcggccagcugaucgccgagagaaagagccagaccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuucagaaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccagaaccuacaucugcuaccugcugaugccccuguucaugcccaucgccuacuucuacggcuggagcuacaacaagagcugcaagaagugccagugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucgugguggagaagggcaucaaggaguacgugguguucuacaccagcaucuucggcgcccuguuccugcugauggcccugaucaucaucaucgcccugaacagagugaccgaguaccugaccaacaucaacguguucuacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaugauccuggugugccugcugaucgcccagaacaccauccugaucguggccgccagcgacgacugcuggaccaagagaagccuggagaugggcugcaucggcccccugcagcagguggacaccugcgacgacaagaccagcagaagcuacagcggcgaggccaagaagcuggugagagccagcaagaucagcgaccuggacgccgcccaggugggccugcugggcagcaccaucgagagcgccaucgccagcaucagaaagcagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccagcgagaugaacagcaccuaccagagcaagagagacuucuucgagcacgacuucaagcaguucugcacccugaucgagaacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaugagccugcccuacgugaacgagaccagccugagccccacccagcuggccaaggugcuggaggugaccgaccaccaccacagaagcaucagcggcagacaggagagccuggccagcgccgcccccggcagcaagagcagcgagugcgaccacgccagaagagugagcugcaucagccccagauucggcgugcccaucgagggccugaccgccugcggcagcagccccaacuacaagaucuacaagacccccgccaagcuguacaagagcaacaacaagggcgagguguggugcagcggcgacgugcacugccugcaggagcugauccccgccccccaggagagcguggacagaaucaagcagaugaccugcuuccugaccgagcccggcgugaacgacgacaucuucagcaucgccaucagcaugugcaaggugcaggacaagggcgugugcaccaucaacgaggacagauggaacguggugaagugcgacagaggccugaucuacuacaccgaccagagagagggccaggacaccggcaacgacuucggcaaguacugccugagccacagcugcagaaucgagagauuccccaucaaccccgccaucaucaacgacugccugugggaguaccacagcagaaagagcaaguacaucaccagccuggaccuggagagccuggaggaguucaagagagccaucagcgagaagcugagccacacccugaucgugcacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugauccacgacgagcacugcaccggccagugccccaccgacaucccccacaaggagaacuggaucaccuucgcccaggagagaaccagcagauggggcugcgaggaguucggcugccuggccaucaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaucuuccacagcagacugaugaucaccagcaccaagcaggacuacggcaucaagaugagcugcaagaccaagcccggccccaccgaggaguuccagaucugcaagaagaccuacaccauccuguucaccaccaucgagaagaacgacaagaucgagaucagcaccggcgaccagaccagcuucauccaggagagagacgacagaugcagaaccuggcugugcagagugagagacgagggcaucggcgugaucuucgagcccaucagagccuucuucggcagcuacuucagcaucgccuucuacaucgugaucggcaucaucauccuguuccuggugaucuacaucuuccugcccaugguguucaagcugagagacgugcugaagagaaacgaguaccuguaccugcaggagaucaagcacaaguga

SEQ ID NO: 9247 - RNA, 4305 nt, Artificial Sequence
  derived and/or modified CDS sequence (opt4) from BATV(ON-1/E/94)__AB257764.1__GP
augcugcuguuccuggugcugcugaucagcugcuacgugagcgccagccccgugaucaccagaugcuuccacggcggccagcugaucgccgagagaaagagccagaccgccaucagcgaguucugccugaaggacgacgugagcaccaucaagagcgagaucaucuacgagaagaacgacaccggccuguucgcccacagcaaggugcugagaaacuggaucaucaaggacuggaagaacugcaaccccgugcccaccgccggcggcagcaucaacgugaucgaggugaacgccgaccugagccuggccaccaagaccuacgugugcagcagagacugcaccaucaccguggacaaggaggacgcccagaucguguuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucgugguggagaagggcaucaaggaguacgugguguucuacaccagcaucuucggcgcccuguuccugcugauggcccugaucgugaucaucgcccugaacagagugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaucauccuggugugccugcugaucgcccagaacaccauccugaucguggccgccagcgacgacugcuggaccaagaagagccuggagauggagugcgugggcccccugcagcagguggacaccugcgaggacaagaccagcagaagcuacagcggcgaggccaagaagcuggugagagccagcaagaucagcgaccuggacgccgcccaggugggccugcugggcagcaccaucgagagcgccaucgccagcaucagaaagcagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagagagacuucuucgagcacgacuucaagcuguucugcacccugaucgagaacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaugagccugcccuacgugaacgagaccagccugagccccacccagcuggccaaggugcuggaggugaccgaccaccugcacagaagcaucagcggcagacaggagcugcugaccagcgccacccccggcagcaagagcagcgagugcgaccacgccaagaaggugagcugcaucagccccagauucggcgugcccauggagggccugaucgccugcggcaacagccccagcuacaagaucuacaagacccccaccaagcuguacaagagcaacaacaagggcgagguguggugcagcggcgacgugcacugcuuccaggagcugauccccgccagccaggagagcguggacagaaucaagcagaugaccugcuuccugaccgagcccgaggugagcgacgacguguucagcaucgccaucagcaugugcaaggugcaggacaagggcgugugcaccaucaacgaggacagauggaacgugaucaagugcgacagcggccugaucuacuacaccgaccagagagagggccaggacaccggcaacgaccugggcgaguacugccugagccacagcugcagaaucgagagauuccccaucaaccccaucaucaucagcgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucguggugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccaagcaggacuacggcaucaagaugagcugcaagaccaagcccggccccaccgaggaguuccagaucugcaagaagaccuacaccauccuguucaccaccguggagaagaacgacaagaucgagaucagcaccggcgaccagaccagcuucauccaggagaaggacgacagaugcaagaccuggcugugcagagugagagacgagggcaucagcgugaucuucgagcccaucagagccuucuucggcagcuacuucagcaucgccuucuacaucgugaucggcaucaucgugcuguuccuggugaucuacaucuuccugcccaugaucuucaagcugagagacgugcugaagagaaacgaguaccuguaccugcaggagaucaagcacaaguga

SEQ ID NO: 9248 - RNA, 4305 nt, Artificial Sequence
  derived and/or modified CDS sequence (opt4) from BATV(ON-7/B/01)__AB257765.1__GP
augcugcugcugcuggugcugcugauccccugcugcgugagcgccagccccgugaucaccagaugcuuccacggcggccagcugaucgccgagagaaagagccaggccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugccccugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccuguuccugcugaucgcccugaucgugaucaucgcccugaacagagugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaaggugaucaugaugauccuggugugccugcugaucgcccagaacaccauccugaucguggccgccagcgacgacugcuggaccaagaagagccuggagaugggcugcaucggcccccugcagcagguggacaccugcgacgacaaggccagcagaagcuacagcggcgaggccaagaagcuggugagagccagcaagaucagcgaccuggacgccgcccaggugggccagcugggcagcaccaucgagagcgccaucgccagcaucagaagacagagaaccuacagcaccaugcaccugcuggagagcguguuccugggcaagcacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagagagacuucuucgagcacgacuucaaccuguucugcacccugaucgagaacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaucagccugcccuacgugaacgagaccagccugagccccacccagcuggccaaggugcugguggugaccgaccagcaccacagaagcaucagcggcagacaggagagccuggccagcgccacccccggcagcaagagcagcgagugcggccacgccaagaaggugagcugcaucagccccagauucggcgugcccauggagggccugauggccugcggcagcagccccaacuacaagaucuacaagacccccgccaagcuguacaagagcaacaacaagggcgagguguggugcagcggcgacgugcacugcuuccaggaccugauccccgccagccaggagagcguggacagaaucaagcagaugaccugcuuccugaccgagcccgaggugaacgacgacguguucagcaucgccaucgccaugugcaaggugcaggacaagggcgugugcaccaucaacgaggacagauggaaccugaucaagugcgacagcggccugaucuacuacaccgaccagagagagggccaggacaccggcaacgacuucggcgaguacugccugagccacaacugcaagauggagagauuccccaucaaccccgccaucaucagcgacugccugugggaguaccacagcagaaagagcaaguacaucaccagccuggaccuggagagccuggaggaguucaagagagccaucagcgagaagcugagccacacccuggugguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaaccugagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcaacuucaagaucgugagcaacaucgacaccgugugcagcaucgagggccccugcaccaccuuccacaacagacugaugaucaccagcgccaagcaggacuacggcaucaagaugagcugcaagaccaagcccggccugaccgaggaguuccagaucugcaagaagaccuacaccgugcuguucgccaccguggagaagaacgacgagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacaucgugaucggcaucaucgugcuguuccuggugaucuacaucuuccugcccaugguguucaagcugagagacgugcugaagagaaacgaguaccuguaccugcaggagaucaagcacaaguga

SEQ ID NO: 9249 - RNA, 4305 nt, Artificial Sequence
  derived and/or modified CDS sequence (opt4) from BATV(UgMP-6830)__DQ436460.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagaagaacaacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccuguuccugcugauggcccuggugaucaucaucgcccugaacaaggugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaugauccuggugugccugcugaucgcccagaacaccauccugaucguggccgccagcgacgacugcuggaccaagaagagccuggagauggagugcaucggcccccugcagcagguggacaccugcgacgacaagagcagcagaagcuacagcggcgaggccaagaagcuggugagagccagcaagaucagcgaccugaacgccgcccaggugggccugcugggcagcaccaucgagagcgccaucgccagcaucagaaagcagagaaccuacagcaccaugcaccugcuggagagcguguuccugggcaagcacugcgacuacuacaaggccuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgaccugaagcuguucugcacccugguggagaacgccuuccccggcaccaccgagagccuguucuacgagaugcugagcaagaagaacaccaccggcgugaagaagcugcuggacaagcugaccaagaaguucggcaacaacaacauguucgugggcaucuggaaguucggccaguaccugaugagccugcccuacgugaacgagaccagccugacccccgcccagcuggccaagauccuggaggugaccgaccagcaccacagaagcaucagcggcagacaggagagccuggccagcgccacccccggcagcaagagcaaggagugcggccacgccaagaaggugagcugcaucagccccagauucggcgugcccauggagggccugcuggccugcggcgacagccccaacuacaagaucuacaagacccccgccaagcuguacaagagcaacaacaagggcgagguguggugcagcggcgacgugcacugcagccaggagcugagccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagacggccaggacaccggcaacgacuucggcgaguacugccugagccacagcugcagaaucgagagauuccccaucaaccccgccaucaucagcgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccaucuacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccaagcaggacuacggcaucaagaugagcugcaagaccaagcccgaggagaccgaggaguuccagaucugcaagaagaccuacaccgugcuguucaccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacgugguggugagcaucaucgugcuguuccuggccaucuacaucuuccugcccaugguguucaagcugagagacgugcugaagaagaacgaguaccuguaccugcaggagaucaagcacaaguga

SEQ ID NO: 9250 - RNA, 4305 nt, Artificial Sequence
  derived and/or modified CDS sequence (opt4) from BATV(ZJ2014)__KU746870.1__GP
augcuggugcugcuggugcugcugauccccugcugcgugagcgccagccccgccaucaccagaugcuuccacggcggccagcugaucgccgagagaaagagccagaccgccaucagcgaguucugccugaaggacgacgugagcaccaucaagagcgagaucaucuacgagaagaacgacaccggccuguucgcccacaacaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccagaaccuacaucugcuaccugcugaugccccuguucaugcccaucgccuacuucuacggcuggagcuacaacaagagcugcaagaagugccagugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucgugguggagaagggcaucaaggaguacgugguguucuacaccagcaucuucggcgcccuguuccugcugauggcccugaucgugaucaucgcccugaacagagugaccgaguaccugaccaacaucaacguguucuacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaugauccuggugugccugcugaucgcccagaacaccauccugaucguggccgccagcgacgacugcuggaccaagaagagccuggagaugggcugcaucggcccccugcagcagguggacaccugcgacgacaagaccagcagaagcuacagcggcgaggccaagaagcuggugagagccagcaagaucagcgaccuggacgccgcccaggugggccugcugggcagcaccaucgagagcgccaucgccagcaucagaaagcagagaaccuacagcaccaugcaccugcuggagagcguguuccugggcaaguacugcgacuacuacaagguguucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccagcgagaugaacagcaccuaccagagcaagagagacuucuucgagcacgacuucaagguguucugcacccugaucgagaacgccuuccccggcaccaccgagagccuguucuacgagaugcugagcaagaagaacaccaccggcaucaccaagcugcuggacaagcugaccaagaaguucggcaacaacaacauguucgugggcaucuggaaguucggccaguaccugaugagccugcccuacgugaacgagaccagccugagccccacccagcuggccaaggugcuggaggugaccgaccaccaccacagaagcaucagcggcagacaggagagccuggccagcgccgcccccggcagcaagagcagcgagugcgaccacgccaagaaggugagcugcaucagccccagauucggcgugcccaucgagggccugaccgccugcggcagcagccccaacuacaagaucuacaagacccccgccaagcuguacaagagcaacagcaagggcgagguguggugcagcggcgacgugcacugccugcaggagcugauccccgccagccaggagagcguggacagaaucaagcagaugaccugcuuccugaccgagcccggcgugaacgacgacaucuucagcaucgccaucagcaugugcaaggugcaggacaagggcgugugcaccaucaacgaggacagauggaacguggugaagugcgacagcggccugaucuacuacaccgaccagagagagggccaggacaccggcaacgacuucggcgaguacugccugagccacagcugcagaaucaagagauuccccaucaaccccgccaucaucaacgacugccugugggaguaccacagcagaaagagcaaguacaucaccagccuggaccuggagagccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucaccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugauccacgacgagcacugcaccggccagugccccaccgacaucccccacaaggagaacuggaucaccuucgcccaggagagaaccagcagauggggcugcgaggaguucggcugccuggccaucaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgacggccccugcaccaucuuccacaacagacugaugaucaccagcaccaagcaggacuacggcaucaagaugagcugcaagaccaagcccggccccaccgaggaguuccagaucugcaagaagaccuacaccauccuguucaccaccaucgagaagaacgacaagaucgagaucagcaccggcgaccagaccagcuucauccaggagagagacgacagaugcagaaccuggcugugcagagugagagacgagggcaucagcgugaucuucgagcccaucagagccuucuucggcagcuacuucagcaucgccuucuacaucgugaucggcaucaucauccuguuccuggugaucuacaucuuccugcccaugguguucaagcugagagacgugcugaagagaaacgaguaccuguaccugcaggagaucaagcacaaguga

SEQ ID NO: 9251 - RNA, 4305 nt, Artificial Sequence
  derived and/or modified CDS sequence (opt4) from CVV__AF082576.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugccagugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcaucuggaaguucggccaguaccugcugacccugcccuacaucaacaacaccgagcugagccagaacagaagacugaccauccuggccacccaggagcugcugagcagaagccacagcggcagacaggagagcaugagcaacgccauccagggcagcaucaccaaggagugccacaacgccaagggcgugggcugcaucagcccccaguucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacacccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugagcaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9252 - RNA, 4305 nt, Artificial Sequence
  derived and/or modified CDS sequence (opt4) from CVV(Montgomery County/VA/2015 4b)__KX583998.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaccaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugaacagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaacagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccagaagaaacgugaucuacugcgaggagugcagcauguaccacagcaagagaggcaucaaguacaacggcgacuucaccaacaagugcggcuucugcaccugcaacgagcaggaggacgccgagggccuggugauccacaaggugagcaagagaugcaccuacaaguaccagcugaagugggccaaggugcugauggugacccuggugcugcugcugaucgcccagaacaccauccugaucguggccgccggcaccgacugcugggccaagaagagccuggacauggacugcaucggccccaugcuggacaucggcagcugcaccaacaagaacaccagaaacuacgacaccgaggcccagaagcuggugagccagagcaaggugagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaagauccugggcaagcugaucaccaaguacggcaacaacaacauguucgugggcguguggaaguucggccaguaccugcugacccugcccuacaucaacaacaccgagcugagccagaacagaagacagaccauccuggccacccaggagagccugagcagaagccacagcggcagacaggagagcaugagcagcgccauccagggcagcgugaccaaggagugccacaacgccaaggacgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaaggugaagaagcugaccugcuuccugaccgacgugagcgugaagaccgacaucuucagcguggccgugagcaccugcaagauggccgacaagggcaccugcaccgugaaggacgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccaugaccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaucaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccguggagcccaagaucaccgacgagaucgagcugcaguucaagaccguggacaccaagacccugcccaaccugcuggccgugcagaacagaaagcuguacagcggccagaucaacgaccugggcagcuucagccagggcugcggcaacgugcagaagaccaaccacagcauccugggcaugggcaccgccaaguucgacuacgugugccacggcgccagcagaaaggacgugaucgugagaagaugcuacaacaacaacuucgacagcugcagacugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9253 - RNA, 4305 nt, Artificial Sequence
  derived and/or modified CDS sequence (opt4) from CVV(Montgomery County/VA/2015 K)__KX583999.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaccaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugaacagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaacagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccagaagaaacgugaucuacugcgaggagugcagcauguaccacagcaagagaggcaucaaguacaacggcgacuucaccaacaagugcggcuucugcaccugcaacgagcaggaggacgccgagggccuggugauccacaaggugagcaagagaugcaccuacaaguaccagcugaagugggccaaggugcugauggugacccuggugcugcugcugaucgcccagaacaccauccugaucguggccgccggcaccgacugcugggccaagaagagccuggacauggacugcaucggccccaugcuggacaucggcagcugcaccaacaagaacaccagaaacuacgacaccgaggcccagaagcuggugagccagagcaaggugagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaagauccugggcaagcugaucaccaaguacggcaacaacaacauguucgugggcguguggaaguucggccaguaccugcugacccugcccuacaucaacaacaccgagcugagccagaacagaagacagaccauccuggccacccaggagagccugagcagaagccacagcggcagacaggagagcaugagcagcgccauccagggcagcgugaccaaggagugccacaacgccaaggacgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaaggugaagaagcugaccugcuuccugaccgacgugagcgugaagaccgacaucuucagcguggccgccagcaccugcaagauggccgacaagggcaccugcaccgugaacgacgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccaugaccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaucaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccguggagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgccaaguucgacuacgugugccacggcgccagcagaaaggacgugaucgugagaagaugcuacaacaacaacuucgacagcugcagacugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9254 - RNA, 4305 nt, Artificial Sequence
  derived and/or modified CDS sequence (opt4) from CVV(1156)__EU583730.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaagaucagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccugaccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacguggugaucggcaucaucgugcuguuccugaucaucuacaucuuccugcccauguucuucaagcugaaggacgugcugaagagaaacgaguaccuguaccugcaggagcugaagcacaaguga

SEQ ID NO: 9255 - RNA, 4305 nt, Artificial Sequence
  derived and/or modified CDS sequence (opt4) from CVV(6V633)__KX100134.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcaucuggaaguucggccaguaccugcugacccugcccuacaucaacaacaccgagcugagccagaacagaagacugaccauccuggccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacacccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9256 - RNA, 4305 nt, Artificial Sequence
  derived and/or modified CDS sequence (opt4) from CVV(807270)__AF186243.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugccagugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccuggccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9257 - RNA, 4305 nt, Artificial Sequence
  derived and/or modified CDS sequence (opt4) from CVV(856 clone 1)__EU583732.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucgccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaucaagaagagccuggacaucgacugcaucggccccaugcuggacaucggcagcugcaccaacaagaacaccagaagcuacgacgccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagagaaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccugaccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacguggugaucggcaucaucgugcuguuccugaucaucuacaucuuccugcccauguucuucaagcugaaggacgugcugaagagaaacgaguaccuguaccugcaggagcugaagcacaaguga

SEQ ID NO: 9258 - RNA, 4305 nt, Artificial Sequence
  derived and/or modified CDS sequence (opt4) from CVV(856 clone 3)__EU583731.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucgccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaucaagaagagccuggacaucgacugcaucggccccaugcuggacaucggcagcugcaccaacaagaacaccagaagcuacgacgccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagagaaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccugaccacccacgagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacguggugaucggcaucaucgugcuguuccugaucaucuacaucuuccugcccauguucuucaagcugaaggacgugcugaagagaaacgaguaccuguaccugcaggagcugaagcacaaguga

SEQ ID NO: 9259 - RNA, 4305 nt, Artificial Sequence
  derived and/or modified CDS sequence (opt4) from CVV(CK102)__AF186242.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccugguggugagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacaccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccuggccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaaccugccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucagcggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9260 - RNA, 4305 nt, Artificial Sequence
  derived and/or modified CDS sequence (opt4) from CVV(CK-102)__KX100146.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccugguggugagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacaccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccuggccacccaggagcugcugagcagaagccacagcggcagacaggagagcaugagcaacgccauccagggcagcaucaccaaggagugccacaacgccaagggcguggagugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaaccugccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9261 - RNA, 4305 nt, Artificial Sequence
  derived and/or modified CDS sequence (opt4) from CVV(MI80-1-450)__AF186241.1__GP
augcuguuccugcugauccuggccuuccugggcuucagcaccagcaaccccaucgccaccagaugcuuccacggcggccaccugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcaacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagccaggugcugggcaagcugaucaccaaguacggcaacaacaacauguucgugggcguguggaaguucggccaguaccugcugacccugcccuacaucaacaacaccgagcugagccagaacagaagacugaccauccuggccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9262 - RNA, 4305 nt, Artificial Sequence
  derived and/or modified CDS sequence (opt4) from CVV(MI80-1-450)__KX100149.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcaacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagccaggugcugggcaagcugaucaccaaguacggcaacaacaacauguucgugggcguguggaaguucggccaguaccugcugacccugcccuacaucaacaacaccgagcugagccagaacagaagacugaccauccuggccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9263 - RNA, 4305 nt, Artificial Sequence
  derived and/or modified CDS sequence (opt4) from CVV(MNZ-92011)__KC436107.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaccaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugaacagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaacagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccagaagaaacgugaucuacugcgaggagugcagcauguaccacagcaagagaggcaucaaguacaacggcgacuucaccaacaagugcggcuucugcaccugcaacgagcaggaggacgccgagggccuggugauccacaaggugagcaagagaugcaccuacaaguaccagcugaagugggccaaggugcugauggugacccuggugcugcugcugaucgcccagaacaccauccugaucguggccgccggcaccgacugcugggccaagaagagccuggacauggacugcaucggccccaugcuggacaucggcagcugcaccaacaagaacaccagaaacuacgacaccgaggcccagaagcuggugagccagagcaaggugagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccgccggcgccagcaagauccugggcaagcugaucaccaaguacggcaacaacaacauguucgugggcguguggaaguucggccaguaccugcugacccugcccuacaucaacaacaccgagcugagccagaacagaagacagaccauccuggccacccaggagagccugagcagaagccacagcggcagacaggagagcaugagcagcgccauccagggcagcgugaccaaggagugccacaacgccaaggacgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaaggugaagaagcugaccugcuuccugaccgacgugagcgugaagaccgacaucuucagcguggccgccagcaccugcaagauggccgacaagggcaucugcaccgugaacgacgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccaugaccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaucaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccguggagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgccaaguucgacuacgugugccacggcgccagcagaaaggacgugaucgugagaagaugcuacaacaacaacuucgacagcugcagacugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9264 - RNA, 4305 nt, Artificial Sequence
  derived and/or modified CDS sequence (opt4) from CVV(MPB1-1551)__KX100143.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccuggccacccaggagauccugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggaggugaucaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacacccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacagcuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9265 - RNA, 4305 nt, Artificial Sequence
  derived and/or modified CDS sequence (opt4) from CVV(W308-67)__KX100140.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugacccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacgagaccaagugccagaacggcgacugggacuucgccggcgagaugaacgagaccuacaagagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccuggccacccaggagauccugagcagaagcuacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggaggugaucaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacacccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcuacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9266 - RNA, 4305 nt, Artificial Sequence
  derived and/or modified CDS sequence (opt4) from CVV(W728-67)__KX100137.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaagauccugggcaagcugaucaccaaguacggcaacaacaacaugguggugggcguguggaaguucggccaguaccugcugacccugcccuacaucaacaacaccgagcugagccagaacagaagacugaccauccuggccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacacccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9267 - RNA, 4305 nt, Artificial Sequence
  derived and/or modified CDS sequence (opt4) from CVV(WI-03BS7669)__KX100152.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugauccugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaucaagaagagccuggacaucgacugcaucggccccaugcuggacaucggcagcugcaccaacaagaacaccagaagcuacgacaccgaggcccagaagcuggugagccagagcaagaucagccagcuggacgccgaccaggugagccugcugggcaacagcaucgacagcgccaucaaggccaucagagcccagaagaccuacagcaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccugaccacccaggagcugcugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9268 - RNA, 4317 nt, Artificial Sequence
  derived and/or modified CDS sequence (opt4) from CHLV(CHLV-Mex07)__JN808310.1__GP
auggagcccagcaucaagcuguuccugauccuggccaucgccgccgccgccgugcacagccugcccgccagcagaugcuucagcgagggcaucgugaucaaggagaagcaggacagcaaggccgugagcgaguucugccugaaggacgacgugagcaugaucaagagccacgugguguacagcaagaacgagagcggcaucuucgccaacagccagauccugagaaaguggaucaucaaggacuggaagcugugcagcccccugcccaccgccggcggccagaucaacgugaucgagaucaaccacgaccugacccugagcaccaagaccuacgugugcaccaccgacugcaccaucggcaucgacaaggagaacgcccagaucaccuuccagaccaacaagcugaacuacuucgaggugagcggcaccaccaucagcagcggcugguucaagagcaagaccagcgugagccuggaccagaccugcgagcaccugaaggugagcugcggcaagaagagcaugcaguuccacgccugcuucaagcagcacaugagcugcaucagauaccugcacagaaccgcccugcccggcuacauggccgccagcaucugcagcaacaucgagcugaucaucaugaccacccugacccuggccaucuucauccugcugugcaucaucaccaagaccuacaucugcuaccugcugaugccccuguucaugcccaucgccuacaucuacggcuggcuguacaacaagagcugcaagaagugcaacugcugcggccugagcuaccaccccuucaccaacugcggcagcuacugcgugugcggcgccaaguucgagaccagcgacagaaugagaauccacagagagagcggccugugccagggcuacaagagccugagaguggccagaaagcugugcaagagcaagggcagcagccuggugaucagcaucacccugagcguguucaucuucagcuucaucacccccaucggcggcgccaucaucaacgacaagcugagcgaggagaaguacagcaucaaccagaugauggacgccaucguggaccuggagaacuucagccacaacgugagcggcacccagcaggugaucagcgugaucuuccugcugaucagcugccuguuccugcugcugaccuaccaccugaacaagaucauccagcaccuggccagauucggccugcuguucugcgaggagugcagcauguaccacagcaagaaggacaucaaguacaacggcgacuucaccaacaagugcggcuucugcaccugcggccagcccgaggaccccgagggccugaaccugcacauccugagccagaacugcaccuacaagcagcaguucaagugggugaagaucaucaucagcauccugcugagccugaucaucaucgagaacagcaugauccuggccgccgccgagaccgacugcuucagcgagaagcagaucagcgaguucugccugggcccccugcugagcaucagcagcugcgaggacaagaacagcagaaccuucaagggcgaggcccagaagcugguggcccugaagaagaucaccagcgacgaggccaugcugaucgagagcaugggcgccaacguggagggcgcccuggagaugauccaggcccagaagagccccgacagcauguacaccauggaguacguguuccugaacaccuacugcgacuacuacagccuguucgagcacaacagcggcuacagccaggugaaguggagauacauccugaagacccaccaguucgacgccugcgccagacacagcaacagccacuucugcagaugcaugagcgacggcaugcacugccccagcagcgacugggacaucgccgacgagcuggacaacaccuacaucaccaagcccaacuucuucaagcacgacuacaaccugcugcuggacgugaucaccgccgccuuccccggcaccggcgccguguucgugaucgacgccugcaagaaggccaacgccaccgccaucaagaccuucagcaacaacaucaucgccagauuccccuacaacaaccugcugaagggcgugaugaaguuccugcaguacaucagcaagcaccccagcuucaagaaguaccagcccgacaccagacacuacgaccugauccccguggcccccaccgccagaggcagaagccugggcagaagcaacagcuacaacaacgcccagaucggcagccccaccaaggacugccagaugcugaaggaggugggcugccugagccccaaguucggccugccccuggagagcaucaucagcugcggcagcagccccaacuacaagcuguacaagaagccccagaaguacuacaagagcaacaacaaggagaacaccuggugcagcaaggacgugcacugccugcacgacuucgagcccaucaccgaggacgugcuggagaaggugaaggugaugaccugcugggagaucgagcccggcaccaucgaggacaucuucaccaucgccagcgagaccugcaagaucaacgacagaggcgugugcgaggugaacgccgccaaguggaagaucgugaagugcgagaccggccuguacuacuacaccgaccacagagagggcgacgacaccggcagcgaccugggccacuacugccugacccacaagugcgccggcggcagauaccccaucaaccccgagauccugcagaacugcgugugggaguuccacagccagaagagccaguacaucaaccagguggaccuggagcagaucgaggaguacaagaaggcccugaccgagaagcugacccacacccugaaccacuacaacuuccugcccaccaagaaccugccccacaucagccccaacuacaaguacgugacccugaacggccaggagaccagcgacggcaucgagaacagcuacaucgugagcgagauccccgccaucgccggcaccagcaucggccugaaggugcagaccaagaccaacgacgacaucuucgaccugaucaucuacgugaagagagccgacaucaucgccagcuacaaccacaucuacgacaccggccccaccaucggccacaacguggagcacgaggagcugugcaccggccagugcccccagcacauccccgccaaggccaacuggcugaccuucagccaggagagaaccagcagauggggcugcgaggaguucggcugccuggccaucaacaccggcugcguguacggcagcugccaggacaucaucaagcccguggccaagguguacagaaagagcaccgaggagaagguggagcuggagcugugcaucgugcugcccgacaagaacuucugcaccacccugaacgcccuggagcccaagaucaccgaggagaucgagcugcaguucaagaccaucgaccagaugagccugcccaacaucgugcugcugagagaccacaagcuguucaagggccagaucaacgaccugggcaccuucggccagaacugcggcaacgugcagaagaccaaccagagcauccugggcgccggcaccgugagauucgacuaccugugccacagcgccagcagaaaggacaucaucaucagaagaugcuacaacaacaacuacgacagcugcaaccaccugcagcuggccgagagccugaucuuccuggacaaccacgagacccuggaggugagaaagcccaaccacauccugggcacccugagcaugaagcugaugcugggcgacuuccaguacaagaccuucgccaaggacaucgagcuggacuucaccggcagaugcgugggcugcaucggcugcuucgagggcuucgugugcgagaugcacaucaccaccaccguggaggccaccugcaaccuggaggccagcugccaguucuuccacaaccagcugcacaucaagcccgacgugcugaaguacuacaccaagaugaccugccagaccgacgaguacauccccagcaagaucaagaucugcaacaaggaguacaagaucaccgugggcaaggugcagaagaacgacaagaucgagaucgacaacagcgaccagaccagcuacaucaaggagaaggacgagagaugcaagaccuggcugugcagagugagagacgagggcaucagcgugaucuucgagccccugcugaacaucuucggcaacuacggcagaaucgccguggccgugaucagcgccauccuggcccugaucauccugguguacauccugaugcccaucugcaugagaaucagagacauccugaagaccaacgagagagaguuccugaucgagagcaaguacaaguga

SEQ ID NO: 9269 - RNA, 4305 nt, Artificial Sequence
  derived and/or modified CDS sequence (opt4) from FSV(86MSP18)__KX100131.1__GP
augcugagccugcugauccuggcccugcugggccugagcaccagcaaccccaucgccaccagaugcuuccacggcggccagcugaucgccgagagcaagagcgccaccagcaucagcgaguucugccugaaggacgacgugagcaugcugaagagcgaggugaucuacaccaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugaugaucaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccaacuaccccgacagcagaaaguacacccuggaggagaucaccgacgugguggagggccugaucagcgagcagaacaucaaggaguacaucguguucuacaccagccuguucggcagccugauccugcugcuggccuucaucaugagcaucacccugagcaagaucaccagcauccuggccagaagaaacgugaucuacugcgaggagugcagcauguaccacagcaagagaggcaucaaguacaacggcgacuucaccaacaagugcggcuucugcaccugcaacgagcaggaggacgccgagggcguggugauccacaaggugagcaagagaugcaccuacaaguaccagcugaagugggccaaggugcugaugaucacccuggugcugcugcugaucgcccagaacaccauccugaucguggccgccgagaccgacugcugggccaagaagagccuggacaucaacugcaucggccccaugcugaacaucggcagcugcaccaacaagaacaccagaagcuacgacaccgaggcccagaagcuggugagccagagcaaggugagccagcuggacgccgaccaggccagccugcugggcagcagcaucgacagcgccaucaaggccaucagagcccagaagaccuaccccgccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuaccugcacgaccugaaccuguucuacaccaucuucgagaacgccuuccccggcaccaccgagagccuguucuaccagcugauccagaagagaaacaccaucggcgccagcaaggugcugggcaagcugaucaccaaguacggcgacaacaacauguucgugggcguguggaaguucggccaguaccugcugacccugcccuacaucaacaacaccgagcugagccagaacagaagacagaccauccuggccgcccaggagcugagcagcagaagccaccccggcagacaggagagcaugagcagcgccauccagggcagcgugaccaaggagugccacaacgccaaggacgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaaggugaagaagcugaccugcuuccugaccgacgugagcgugaagaccgacaucuucagcguggccgccagcaccugcaagauggccgacaagggcgugugcaccgugaacgacgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccaugaccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucgugaagagcgccgugaucagaaccaccuacaaccacaucuacgacaccggccccaccaucggcaucaacacccagcacgacgagcacugcaccggccccugccccgccguggugccccacaaggagaacuggaucaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgccaaguucgacuacgugugccacggcgccagcagaaaggacgugaucgugagaagaugcuacaacaacaacuucgacagcugcaagcugcugaaggaggagaccagccugguguucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccagcaagcagagcuacggccugaagaugagcugccagaccaagcccagccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcaaggugagagacgagggcaucagcgugcuguucgagccccugaaggccuucuucggcagcuacuucagcaucaucuucuacgugguggugggcaucaucgugcuguuccuggugaucuacaucuuccugcccauguucuucaagcugaaggacgugcugaagaagaacgaguaccuguaccugcaggagcugaagcacagauga

SEQ ID NO: 9270 - RNA, 4314 nt, Artificial Sequence
  derived and/or modified CDS sequence (opt4) from GERV__M21951.1__GP
auggccaucagcaccagccugcugaucguggcccugcugaucaagcugugccuggugaacaccgccccccccaucagcaagugcuuccaggacggcauccugaucgccgagcugaagagcagcagcggcaucagcgaguucugcaucaaggacgacaucagcauccugaagagcgagaucaccuacagcaagaacgacaccggcaucuucaugcacagcaagguguucagacacuggaccguggccgacuggaagcagugcaaccacaccagcgccggcggcagcaccaacgugcuggagguggacaagaaccugaaccugguggccaagaacuacaugugcaccagacccugcgugaucaccaucgacaaggagaacgcccagcugcuguuccagaccgagcagcugaaccaguucgaggugaccggcaccaccaucagcaccggcugguucaagagcaagaccagcgugagccuggacaacaccugcgagcacaucaaggugaccugcggcaagaagagccugcaguuccacgccugcuucaagcagcacaugagcugcgugagauuccugcacagaagcgugcugcccggcuacauggccagcagcaucugccagaacaucgagcugaucaucaucaucauccugacccuggccaucuucaucuucaugugcaucaucaccagaaccuacaucugcuaccugaugcugccccuguucgcccccaucgccuaccuguacggcuggcuguacaacagaagcugcaagaagugcaucugcugcggccuggccuaccaccccuucaccaacugcggcagcuacugcgugugcggcagcagauucgagaccagcgacagaaugagacugcacagagagagcggccugugccagggcuucaagagccugagaguggccagaagccugugcaagagcaagggcagcagccuggugaucagcauccugaccgccaugcugauccugagcuucaucaccccccuggaggccaugaccaccaacuaccccgacgacaagaaguucacccugaaggaggugaacgacaucgugcugggcagagacauggagcaggagcugaagagcagcauccugauccugaugagcaucugcggcaucggcaucauccugaucuucuucggccugaccgugcugcuggagaucgugcuggagcugaucgccaagagaagcaccaucuucugcaaggagugcaaccugauccacgacaagaagagcaugaccuacagaggcgacuucaccaacaagugcggcuucugccccugcggcgagcuggaggaccccgagggccuggugauccacaccaccagaaagagcugcaccuacuacaucaagaucagaaaccugaagcugaucaugcugaucuucagcaucgugauccugaugcagaacgccaccaugcuggugguggccggcgagaacugcuggaccaacaccgagaucaaggccgacugcgugggcccccugaucggccccagcgccugcaccaacaagggcagcaagaccuacaagaccguggcccaggagcuggugaccgccagcaagaucacccagcuggacgccgacaaguacgugcugcugggcgacaccaucgagagcgcccuggacgccaucaccagccagaagcacuacagcgccaugcaccugcuggagaccauguuccugaugaagcacugcgacuacuacaagguguacgagcacaacagcggcuacagccagaccaaguggagacugaucgccaucgccaacagcuucgacaucugcaccaacacccccacccccaacuucugcaagugccugagcgacagcagcugcagcaccaccacccugaacuucgccaccagcaugaacgccaccuacaccagcaagguggaguucuucaaccacgacuucacccuguuccuggacaucuucgaggccgccuuccccggcagcgccaccgccuuccuguucaagaagaucaaggagaagaaccccuaccaggccuucgagaugaugggcaagaucgccaacaaguaccccaacaacaagcugcugguggugauccugaaguacggccaguacauggugggccugagccacgccagcaccuaccagcugaagcaggaguggguggccaagagccugagccugaccagagcccagagaaccggccugaagaugagcauggccaacgccgagcccggccccgccaccaaggagugcagcgacgccaagaccaucgccugccugacccccaaguuccagguggaggugaacaaccugaugagcugcggcgccagccccaacuucaagaucuacgugaagaccggcgagcuguacaaggcccacgacagaaacagcguguggugccugaacgacaugcacugccugacccccuacacccccgccaacgccgagaucaucaccaccaugaagaagauggacugcuggcaggacaaccccaagcagcccaccgacgaguacgccauccccaagagaagcugccagaugaaggacagaggccugugcaacagcggcgccgacaaguggaagaucaucaagugcgacaaccacaagcuguucuacaccgacgcccuggagagaagagaccccgccagcaucgugggcagcaaccacugcuucagcgagaagugccagaucgagagauaccccaucaaccccaccagccugaccaacugcgaguggcuguacagagccgugagacccgaguacaucaagaagcugagccugcagaccaucgaggaguacaagaaggccaucgccgacaagcugacccacacccugcagcuguaccacuucgccccccugcuggagaaccugccccacaucaagcccaccuacaaguacaucaccgcccagggcaccuacaccgccgacggcaucgagggcgccagcaucaccaccagcauccccgcccugagcggcaccagcgugggcuucaagaucaacgccaaggacggcaccgaccugcuggacaucgugguguacaucaaggccagcguggugaagagcaucuacaaccacaucuacgacaccggccccaccaucaacaucaacagcaagcacgacgagcugugcaccggccagugccccaagaagauccccgccgaccccaacuggcugaccuucagccaggagagaaccagcagauggggcugcgaggaguucggcugccuggccaucaacaccggcugcguguacggcagcugccaggacgugaucagaaccgagaccaagguguacagaaaggccaacgaggagaccgugaugcugaccgugugcaucaccuaccccggccacaccuucugcaccgacgugaacgcccacgagcccaagaucaccgacgagcuggagcugcaguucaagaccaucgacaucaagagccugcccaaccugguggccgugaccaaccacaagcuguacaccggccagaucaacgaccugggcaccuucggccagaugugcggcaacgugcagaagaccaacaccagccacaccggcgccggcacccccaaguucgacuacaccugcuacagcgccagcagaaaggacaucaucaucagaagaugcuacaacaacaacuacgacagcugcagacugcugaaccaggagagcgaccugcuguucgacgacaaccacgagacccuggugguguacaacaacaagagacugaacggcgagcuggcccugaagcugcugcugggcgacauccaguacaagcuguacaccgagaacauggagcuggagcuggaggccaagugcgugggcugcgugggcugcuucgagagcuaccagugcaaccugcagaucaccagcagccuggacgagaccgcccuguaccuggugcccgugagccacuuccacgacagaauccagaucaagaccaccaagaaggacuacgccaugaagaucagcugcaccagagaccccggcgacaaggccagcuucagagugugcggcaagagcuacgacuucaacuuccacaccgugcccaagaacgacaagaucgaggugaacgugggcgacgagaccagcuacaucaaggagaaggacaacagaugcggcagauggcugugcagagugagagacgagggccugagcgugaucuucgagccccugaacaacuucuucggcaacuaccugaacauguuccuguacauccugggcggcaucauccugcuguuccuggcccuguacauccugaugcccaugugcgccagacugagagacgagcugaagagaaacgagagacugcaccagauggagaugaagaagagauga

SEQ ID NO: 9271 - RNA, 4260 nt, Artificial Sequence
  derived and/or modified CDS sequence (opt4) from IACOV(BeAn314206)__JN572066.1__GP
augagagugaucgcccuguuccaccuggugauggugaucaccgccaaccccguguuccacagaugcuuccagggcggccagcugauccuggagaagaagagccacgugagcaugagcgaguucugccugaaggacgacgugagcauggugaagagcgugguggaguacgagaagaccaacaacagcaucgugggcaccaacaagguguacagacaguggguggugagcgacuggaagcugugccaccccaucaaggccgagggcggcggcaucaacaucaucgagguggagaaggaccugaccaucaagagcaacaccuacaucugcaccaccgacugcaccaucaccguggacaaggagaacgcccagaucaucuuccagaccagcaagcugaaccacuucgaggugaccggcaccacccugagcaccggcugguucaagaccaaggccgccgugacccuggaccagaccugcgagcacaucagagugagcugcggcaagaagagcauccaguuccacgccugcuucagacagcacaugaccugcgugagauuccugcacagaagccugcugcccggcagcauggccaacagcaucugccagaacguggagcugaucaucaucaucgugcugacccugcugaucuucaucgugcugaacaucaucgccaagaccuacaucugcuaccugaugcugcccaucuucaugcccaucgccuacaucuacggcuggaucuacaacagaagcugcaagaagugcgugaacugcggccuggccuaccaccccuucagcaacugcggcagccacugcgugugcggcgccaucuuccagaccagcgacagaaugagaaugcacagagagagcggccugugcagcggcuucaagagccugagaguggccagagugcugugcaagagcaagagcagcagccuggugaucgccauccugagcagccugcugauccugagcuucgugacccccaucgagggccuggaccuggaggagaagaaguacagccugagcgaccugcccgacaucuacaccaaggagcugaacacccugagcgagaagaucgccaucaacuucuacaucagcaucaccaacaugcugaucaccaucauccugcugaucguggccuucugcagccacugcaucaccaacaagaucgugaaguacaaggccuuccugugcaccgagugcgacauguaccacaccuacaagaacaucagauacaacggcgacuucugcaacaagugcggcagcugcaccugcggcaccauggaggaccccaacuacaccaccaugcacaaggugagcgaccugugccuggccgagcccaagagaaucauccagaagaagcugaugaucauccugaucaucuucgugaucaucgagaacggcgccugccuggccagcgccgaggagaagugcuucaaggagcacgacuacaacaucgagugcaucggcccccugaucaccaugagacccugcaccaagaagaccauccaggagguggccagaacccuggugaccgacaagcagaucgcccaggaggacaccgagaagaucgagcugcugcccgacagcaucgugcaggccuggaacaugaucgacaaccagcugaacuacgaccagauguuccugauggaguacgccuuccugaagagagagugcagcuucuucgaggaguucgagcacaacagcggcgugaaccagaucauguggagaaccaucgccaagaccggccacuucgacaucugcgccaucagaagcagccagagauucugcaagugcaugagcgagagcguguacugcaaggacgccaacugggacaucgccaacgagaugaacgacaccuacagcuucaagccccuguucuacagacacgacgugaagcuguacagcaagaucuucaaggccgccuuccagggcaccacccugaagaccuacgagaaguuccugaacgccaagaacaagaccgagcugaucaacaugcugaagaagcugggcaagagauuccccuacaacaaccugcugaugggcuuccugaaguucggcgagcugcuguucgaccugacccuguucgacgcccugcccaaggacaagaccagcagaaccagcagcaccaccgccaagagagaguacgagaaccugcaggacgccaaggugggcgagcccaccagcgagugcaaggacaugaagcugcugcagugcaucagccccagauaccaggugagcgugggcagcgugaucaagugcggcgacaccgagaagaagaucuacgacuuccacacccccguguacaagcuggccaccgacgagaccaaguggugcagauucgacaagcacugccugcacgagugggugcccaucgacaacgccagacuggagaugcugaagaagcugaacugcugguacaccgaccccaccgagaugguggacaucuacaccaccagcagaaagagcugcagaaugaucaacaagggcaccugcaacaucaagaacgcccccaugaccgugaugcagugcgacgacgaccugaucuucuacaccgaccacagaagcagcgccgacacccagggcgacaucggcgaguacugccugagccagaacugcgacgugagcagauaccccaucaacgugauggacggcaugaccugcaccugggaguacaacaccgugaagcccaaguaccugagcaagaccgagcugaagacccuggaggaguacaagagaacccugcaggacaagcugagccacaaccuggagguguaccacuuccacaugaccgccaacuucccccacaucaagcccguguacaaguacaucaccgccggcggcguggagaccagcgacggcaucgagggcgccuucauccugguggaccugcccgcccugagcggcaccagcgugggccugaccgugcugagcaaggacgacgugccccugauggacgugaucaucuacaucaagagcgccgugaucaaggccaccuacaaccacaucuacgacaccggccccaccaucggcaucaacgugaagcacgaggagcugugcaccggccccugcccccagaacaucccccaccaggagcaguggcugaccuucagccaggagagaaccagcagauggggcugcgaggaguucggcugccuggccgugggcgagggcugcguguacggcagcugccaggacaucaucaagaaggagaccagaguguacaagaaggugagcgaggagaucaacgagaucaccuucugcaucaucuuccagaccaacaccuacugccagaccaugaacgccaucgagccccagaucacccccagccuggaggugcagcuggagggccuggacaccaagauccugcccaacauccuggcccugcagaaccacaagcuguacagcggccagaucaacgaccugggcagcuucggccuggccugcggcaacgugcagcaggugaacaagaccaucuacggcgccggccagcccaaguucgacuaccugugccacggcgccaagagaaaggacaucaucgugagaaagugcuacaacaacaacuucggcagcugcaagcugcugaccaucgaggacaaccugaucguggaggacaacuacaacaccaucaacgugaucaacaccaagcaccugaucggcaccgugaagagcaagcugaaccugggcgacaucagauacaagcuguucaacaagaagcccgaguucgagcuggaggcccacugcgugggcugcgugggcugcuucgccaacuacaacugcgagaucaagaucgagagcaccaucgacaugaccugccccaucagcggccccugcgaguucuuccacaacaacaucuucauccaggccgagcacaccaaguacgccaugaagaugaucugcaagaagcagcccgaccagaccaccgaguucaccaucugcgacaagaaguaccacuucaucaucgacaccguggagaagcacgaccagaucgagaucgacgugggcgaccagaccagcuacauccuggagaaggacaacagaugcggcaccuggaugugcaaggugcuggacgagggccugagcgugaucuucgagccccugaagcugcugcugggcaacuacuuccacauggccaucgugaucaucaucggccugaucgcccuggccgugaucaucuacauccugcugcccauguucaugaagcugagagacacccugaaggccaacgagaucgccuaccagaaggagaugaagaucaaguga

SEQ ID NO: 9272 - RNA, 4305 nt, Artificial Sequence
  derived and/or modified CDS sequence (opt4) from ILEV(KO/2)__AY859372.1__GP
augcuguuccccaucauccugcugaugauccagcuggugagcagcaccccccugagcaccagaugcuuccacgagggcacccuggugaaggagaagaucagcaccaccagcaucagcgaguucugccugaaggacgacgugagcaugaucaagagcgagaucaccuaccagaagaacgacaccggcguguacggccacagcaagaucuacagaaacuggaucgugaaggaguggaaggccugcaaccccgugcccagcgccggcggcagcaucaacgugaucgaggugaacgaggacaugagccuggccaccaagaacuacaucugcaccagagacugcgugaucaccguggacaaggaggacgcccagaucguguuccagaccgacaaccugaaccacuucgaggugagcggcaccacccugagcagcggcugguucaagaccaaggccagcgugacccuggacagaaccugcgagcacaucaaggugagcugcggcaagaagaccgugcaguuccacgccugcuucagaaaccacaugagcugcgugagauucuuccacaacaccauccugcccggcuacauggccaccagcaucugccagaacaucgagcugaucaucaucaucgugcugaccaucgccaucuucaucaugcuggugauccugaccaagaccuacaucugcuaccugcugaugccccuguucaugcccaucgccuacugcuacggcugggccuacaacaagagcugcaagaagugcaacugcugcggccuggccuaccaccccuucaccaacugcggcagcuucugcgugugcggccugaaguucgaggccagcgacagaaugagaauccacagagagagcggccugugccagggcuacaagagccugagaguggccagaagacugugcaagagcaagggcagcagcuucgugaucagcauccugcugagccuguucauccugagcuucgugacccccaucgagggcaccaugaccaacuaccccgaggagagaaaguacacccuggaggagaucgccgacgugaucgagggcuucuaccaggaggccaagaucaaggaguacaucguguucuacagcagcaucuucggcagcuucauccugaucagcagcaugcugauccuguacaagcugcagaacaucaccuacuuccugagcaaguucaacgugauguacugcagcgagugcagcauguaccacagcaagaagaacaucaaguaccugggcgacuucaccaacaagugcggcuucugcaccugcggcgagcuggaggacgccgagggccugagcauccacaaggugaccaagagaugcaccuacgccuaccagaugaccuggaccaagaucauccuggccacccugcugauccugcugaucggccagaacacccugcugguggugagcgcccaggccgacugcugggagaagaccgagaucaccaucgacugcaucggccccaucuucgcccccaacaccugcaucaagcaggaggagaagaccuacgccaaggaggcccagacccugguggaccagaacaagaucagccaggccgacgccaagcagguggacaugcugggcgccaccaucgacgacgccaucaaggccaucagaagccagaagaccuacaccaccaugcacaugcuggaggccaucuuccugagcaaguacugcgacuacuacagccuguucgagcacaacagcggcuacagccagggcaaguggagacugaucgccaagaccgagagcuucgacaucugcagcagacacaccacccaccacuucugcagaugcaugagcgacgagaccaagugcaagaacggcgacugggacuucgccggcgagaugaacagcaccuaccacagcaagagcaacuuccugcugcacgaccugagacuguucuacaagaucuacagcgccgccuuccccggccugagcgaggccaugcuguacaaguuccugagcgagaaggacaccaccaacgccaucaagcugcuggagaagcuguucaccaaguacagcuacaacaaccugcuggugggcauccugagauucggcaaguuccuguucagcaugagcaucuucaacaccaccgagcugggcggcgcccagaaggccaugauccugagacccaccgacgagcugagaaccaccuacagcggcaagcaggagagccugagcaacagcguggugggcgagcagaccagcgacugcgugaacaugaagaagaucagcugcaucagccccagauucaacaucccccugagcagcaugaucgccugcggcaaccagcccaacuaccagaucuacaaggagcccagcaaguacuacaagagcaacaacaagcccaacaccuggugcaacaaggacauccacugccugaacgacuucgagagcaucgaccagagcgcccuggacagacugaagaccaugaccugcuuccugaucgaccccaucaccaccgaggacguguacagcaucgccauccacagcugcaaggugaaggacaagggccagugcaccaucagagacaagaaguggaacaucaucaagugcgacagcgagcugcuguacuacaccgaccacagagagggcgaggacaccggcaacgagaucggccacuacugccugagccacaagugcggcaccgacagauaccccaucaaccccgagaucaucaaggacugcaucugggaguucagaagcagaaagagcgaguacaucaacagaguggaccuggagagccuggaggaguucaagagagcccugagcgacaagcugacccacacccugaccaucuacaacuucaagcccaccgccaaccugccccacaucaagcccaucuacaaguacaucaccgcccugggcguggagaacagcgacggccuggaggccgccuacauccugaccagcauccccgcccugggcggcaccagcaucggcuacaacaucaugaccaaggacaacuuccccgugauggacgugaucaucuacgugaagagcgccgugauccagaccaccuacaaccacaucuacgacaccggccccaccaucggcaucaacagcaagcacgacgagaagugcaccggcagcugcccccagaacaucacccacgaccagaacuggcugaccuucagccaggagagagccagcagauggggcugcgaggaguucggcugccuggccaucaacaccggcugcguguucggcagcugccaggacaugaucagaagcgacaccaagguguacaagaaggcccuggaggagaccguggugcugaccgugugcaucaacuaccccggcaacaccuucugcaccgaggugaacagcguggagaccaagaugaccgacgacguggagcugcaguucaagaccguggacaccaagacccugcccaaccugcuggccgugaccaaccacaagcuguacagcggccagaucaacgaccugggcagcuucagccagaugugcggcaacgugcagaagaccaacagcaccgugaugggcgccggcaccgugaaguucgacuacaucugccacggcgccagcagaaaggacaucaucaucagaagaugcuacaugaacaacuacgccagcugcagccugcugaaggaggagaaggaccugaucuucgccgacaaccacgagaccaucaccgugagcaacagcaagcaccuggugggcgagcugcagaucaagcugaugcugggcgacaucagauacaagcuguucgccgagagacccgagcuggagguggacgccaagugcgugggcugccccagcugcuucgagagcuacagcugcaacuuccagaucgugaccaacaucgacaccgugugcacccuggagggccccugcaccaucuuccacaacagaaucaucaucagcagcaccaagcagagcuacggcaucaagaugagcugccccaccaagcccaaccacaucgagaaguucaagaucugcaaccacgaguacgacauccuguucgacaccguggccaagaacgacaagaucgagaucgacaccggcgaccagacccuguucgugagagagaaggacaccagaugcaagaccuggcugugcagagugaaggacgagggcaucagcgugaucuucgagccccugagagccuucuucggcagcuacuucagcaucaucuucuacaucauccuggccgccauccugaucuucgugggcguguacaucuuccugcccauguucaugagacugagagacgugcugaagagaaacgagcaccuguaccugcaggagaucaagcacaaguga

SEQ ID NO: 9273 - RNA, 4305 nt, Artificial Sequence
  derived and/or modified CDS sequence (opt4) from ILEV(R5964)__KF234074.1__GP
augcuguuccccaucauccugcugaugauccagcuggugagcagcaccccccugagcaccagaugcuuccacgagggcacccuggugaaggagaagaucagcaccaccagcaucagcgaguucugccugaaggacgacgugagcaugaucaagagcgagaucaccuaccagaagaacgacaccggcguguacggccacagcaagaucuacagaaacuggaucgugaaggaguggaaggccugcaaccccgugcccagcgccggcggcagcaucaacgugaucgaggugaacgaggacaugagccuggccaccaagaacuacaucugcaccagagacugcgugaucaccguggacaaggaggacgcccagaucaucuuccagaccgacaaccugaaccacuucgaggugagcggcaccacccugagcagcggcugguucaagaccaaggccagcgugacccuggacagaaccugcgagcacaucaaggugagcugcggcaagaagaccgugcaguuccacgccugcuucagaaaccacaugagcugcgugagauucuuccacaacaccauccugcccggcuacauggccaccagcaucugccagaacaucgagcugaucaucaucaucgugcugaccaucgccaucuucaucaugcuggugauccugaccaagaccuacaucugcuaccugcugaugccccuguucaugcccaucgccuacugcuacggcugggccuacaacaagagcugcaagaagugcaacugcugcggccuggccuaccaccccuucaccaacugcggcagcuucugcgugugcggccugaaguucgaggccagcgacagaaugagaauccacagagagagcggccugugccagggcuacaagagccugagaguggccagaagacugugcaagagcaagggcagcagcuucgugaucagcauccugcugagccuguucauccugagcuucgugacccccaucgagggcaccaugaccaacuaccccgaggagagaaaguacacccuggaggagaucgccgacgugaucgagggcuucuaccaggaggccaagaucaaggaguacaucguguucuacagcagcaucuucggcagcuucauccugaucagcagcaugcugauccuguacaagcugcagaacaucaccuacuuccugagcaaguucaacgugauguacugcagcgagugcagcauguaccacagcaagaagaacaucaaguaccugggcgacuucaccaacaagugcggcuucugcaccugcggcgagcuggaggacgccgagggccugagcauccacaaggugaccaagagaugcaccuacgccuaccagaugaccuggaccaagaucauccuggccacccugcugauccugcugaucggccagaacacccugcugguggugagcgcccaggccgacugcugggagaagaccgagaucaccaucgacugcaucggccccaucuucgcccccaacaccugcaucaagcaggaggagaagaccuacgccaaggaggcccagacccugguggaccagaacaagaucagccaggccgacgccgagcagguggacaugcugggcgccaccaucgacgacgccaucaaggccaucagaagccagaagaccuacaccaccaugcacaugcuggaggccaucuuccugagcaaguacugcgacuacuacagccuguucgagcacaacagcggcuacagccagggcaaguggagacugaucgccaagaccgagagcuucgacaucugcagcagacacaccacccaccacuucugcagaugcaugagcgacgagaccaagugcaagaacggcgacugggacuucgccggcgagaugaacagcaccuaccacagcaagagcaacuuccugcugcacgaccugagacuguucuacaagaucuacagcgccgccuuccccggccugagcgaggccaugcuguacaaguuccugagcgagaaggacaccaccaacgccaucaagcugcuggagaagcuguucaccaaguacagcuacaacaaccugcuggugggcauccugagauucggcaaguuccuguucagcaugagcaucuucaacaccaccgagcugggcggcgcccagaaggccaugauccugagacccaccgacgagcugagaaccaccuacagcggcaagcaggagagccugagcaacagcguggugggcgagcagaccagcgacugcgugaacaugaagaagaucagcugcaucagccccagauucaacaucccccugagcagcaugaucgccugcggcaaccagcccaacuaccagaucuacaaggagcccagcaaguacuacaagagcaacaacaagcccaacaccuggugcaacaaggacauccacugccugaacgacuucgagagcaucgaccagagcgcccuggacagacugaagaccaugaccugcuuccugaucgaccccaucaccaccgaggacguguacagcaucgccauccacagcugcaaggugaaggacaagggccagugcaccaucagagacaagaaguggaacaucaucaagugcgacagcgagcugcuguacuacaccgaccacagagagggcgaggacaccggcaacgagaucggccacuacugccugagccacaagugcggcaccgacagauaccccaucaaccccgagaucaucaaggacugcaucugggaguucagaagcagaaagagcgaguacaucaacagaguggaccuggagagccuggaggaguucaagagagcccugagcgacaagcugacccacacccugaccaucuacaacuucaagcccaccgccaaccugccccacaucaagcccaucuacaaguacaucaccgcccugggcguggagaacagcgacggccuggaggccgccuacauccugaccagcauccccgcccugggcggcaccagcaucggcuacaacaucaugaccaaggacaacuuccccgugauggacgugaucaucuacgugaagagcgccgugauccagaccaccuacaaccacaucuacgacaccggccccaccaucggcaucaacagcaagcacgacgagaagugcaccggcagcugcccccagaacaucacccacgaccagaacuggcugaccuucagccaggagagaaccagcagauggggcugcgaggaguucggcugccuggccaucaacaccggcugcguguucggcagcugccaggacaugaucagaagcgacaccaagguguacaagaaggcccuggaggagaccguggugcugaccgugugcaucaacuaccccggcaacaccuucugcaccgaggugaacagcguggagaccaagaugaccgacgacguggagcugcaguucaagaccguggacaccaagacccugcccaaccugcuggccgugaccaaccacaagcuguacagcggccagaucaacgaccugggcagcuucagccagaugugcggcaacgugcagaagaccaacagcaccgugaugggcgccggcaccgugaaguucgacuacaucugccacggcgccagcagaaaggacaucaucaucagaagaugcuacaugaacaacuacgccagcugcagccugcugaaggaggagaaggaccugaucuucgccgacaaccacgagaccaucaccgugagcaacagcaagcaccuggugggcgagcugcagaucaagcugaugcugggcgacaucagauacaagcuguucgccgagagacccgagcuggagguggacgccaagugcgugggcugccccagcugcuucgagagcuacagcugcaacuuccagaucgugaccaacaucgacaccgugugcacccuggagggccccugcaccaucuuccacaacagaaucaucaucagcagcaccaagcagagcuacggcaucaagaugagcugccccaccaagcccaaccacaucgagaaguucaagaucugcaaccacgaguacgacauccuguucgacaccguggccaagaacgacaagaucgagaucgacaccggcgaccagacccuguucgugagagagaaggacaccagaugcaagaccuggcugugcagagugaaggacgagggcaucagcgugaucuucgagccccugagagccuucuucggcagcuacuucagcaucaucuucuacaucauccuggccgccauccugaucuucgugggcguguacaucuuccugcccauguucaugagacugagagacgugcugaagagaaacgagcaccuguaccugcaggagaucaagcacaaguga

SEQ ID NO: 9274 - RNA, 4305 nt, Artificial Sequence
  derived and/or modified CDS sequence (opt4) from MAGV__AY286443.1__GP
auggagcugcugaucaucauccugcugcugggcagcgccgccagcagccccaucagcaccagaugcuuccacggcggccagcugaucgccgagagcaagagcgccaccagcaucagcgaguucugccugaaggacgacgugagcaugaucaagagcgaggugaccuacaucaagaacgacaccggcaucuacggccacaacaagguguucagaagcuggaccaucaaggacuggaagcugugcaaccccauccccaccgccggcggcagcaucaacgugaucgaggugaacagcgaccugagccuggccaccagagccuacgugugcagcagagacugcaccaucaccaucgacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagagccugcaguuccacgccugcuucaagcaccacaugagcugcaucagauucuuccaccacaccauccugcccggcaccauggugagcagcaugugccagaacaucgagcugaucaucaucaucggccugacccuggugaucuucauccugauggugauccugaccaagaccuacaucugcuaccugcugaugcccguguucaugcccguggccuacaucuacggcugggccuacaacaagagcugcaagaagugcaacugcugcggccuggccuaccaccccuucaccaacugcggcagccacugcgugugcggccugaaguucgaggccagcgacagaaugagacugcacagagagagcggccugugccagggcuacaagagccugagaaucgccagaaugcugugcaagagcaagggcagcagccuggugaucagcggccugcugagcaugcugcugcugagcuucaucacccccaucgagggcacccugaccaacuaccccaacgagaagcaguacacccuggaggagaucgccgacgugguggagggcaucaucaccgagcagcaccugaaggaguacgugguguucuacaccagccuguucggcggccugauccugcugcugacccugauccugagcaucaccaucaacaaggugaccgaccugcuggccagcaccaacgugaucuacugcgaggagugcagcauguaccacagcaagaagggcaucaaguacaacggcgacuucaccaacaagugcggcuucugcaccugcagcgagcaggaggacguggagggcgugaucauccacaaggugagcagaaagugcaccuacaaguaccagcugaagugggugagagugaucaugaucauccuggcccugcugcugaccauccagaacaccgugcugaucguggccgccgagguggacugcuggaccaagaagagcaucgagaucgacugcaucggcccccugcugaacaucggcagcugcaccgacaagagcagcagaaccuacgagaccgaggugaacaagcuggugagacagagcaaggugacccacgccgacgccgagcagaucagcauccugggcagcacccuggacaacgccaucaaggccgugagaagccagaagaccuacgagaccaugcacuuccuggagaccguguuccugaugaagaacugcgacuacuacaacagcuucgagcacaacagcggcuacagccagaccaaguggagacugaucgccaagaccagccacuucgacaucugcagcagacacagcacccaccacuucugcagaugcgugaacgagggcaccaagugccagaacggcgacugggacuucgccggcgagaugaacgacaccuacaacagcaagaacgacuucuaccugcacgaccuggaccuguucuacacccugcuggagaacgccuuccccggcaccaccgagagccuguucuaccagcugcugcagaagaagaacaccaccggcgccagcaagcugcugggcaagcugaucaccaaguacggcaacaacaacauguucguggagaucuggaaguucggccaguaccugcugaagcugcccuacaucaacgacaccgagcugagcaccgacagaaagagcaccaucaucaagagccagcaggugcugagcagaagccagaccggcagacaggagagccugagcagcgccacccccggcaccgccaccaaggagugcagcaacgccaaggacaucggcugcaucagccccagauucggcauccccaucggcaaccugaccgccugcggcgacagccccaacuacaagguguacaagacccccgagaagaucuacaagagcaacaacagaggcgagguguggugcagcgacgacgugcacugccugaccgacuucgagcccgccgaggaggagguggugaacagaaucaagcagaugaccugcuuccugaccgacgugaccaccaagaccgacguguucagcguggccaucagcaccugcaagaugguggacaagggcgugugcaccgugaacgacgccaaguggaacauccugaagugcaacagcggccuguacuacuucaccgaccacagaggcggccaggacaccggcaacgacuucggcgaguacugcaucagccacagcugcaacaccgagagauuccccaucaaccccgacgugcugaaggacugcaucugggaguaccacagcagaaagagcaaguacaucagcaccgugagccuggagagccuggacgaguucagaagagccaugagcgacaagcugagccacacccugaugaucuacaacuucaagcccaccgccaaccugccccacaucaagcccaccuacaaguucaucaccgccaacggcaucgagaacagcgacggcaucgacagcgccuacauccugagcagcauccccgcccugggcggcaugagcgugggcuacaacauccagaccaaggacaacuucccccugcuggacaucaucguguucaucaagagcgccaucaucaagaccaccuacaaccacaucuacgacaccggccccaccaucggcaucaacacccagcacgacgagcacugcaccggccccugccccacccugaucccccacaaggagaacuggcugaccuucagccaggagagaaccagcagauggggcugcgaggaguucggcugccuggccaucaacaccggcugcguguucggcagcugccaggacaucauccaccccgaggccaagguguacagaaaggccaucgaggaggagguggugcugaccgugugcaucaccuuccccggcaacaccuacugcaccgagaucaacgccaucgagcccaagaucaccgacgagaucgagcugcaguucaagaccguggacaccaagacccugcccaaccugcugauggugcagaaccacaagcuguacagcggccagaucaacgaccugggcagcuucagccagggcugcggcaacgugcagaagaccaaccagagcgugaucggcgccggcaccgccaaguucgacuacgugugccacggcgccagcagaaaggacgugaucgugagaagaugcuacaacaacaacuacgagagcugcaagcugcugaaggaggagaccagccugaucuucgccgacaaccacgagacccuggagguggccaacaccaagcaccugaucggcgagcugcaguucaagaucaugcugggcgacaucagauacaagagcuucgccgagagccccgagcuggagguggacgccaagugcgugggcugccccagcugcuucgagagcuacagcugcaacuuccagaucgugaccaacaucgacaccgugugcagcguggacggccccugcacccuguuccacaacagacugaucaucagcgccaccaagcagagcuacggcuucaagaugagcugccccagaaagcccgagcccaccgaggaguuccagaucugcaacagaaaguacaacgugcuguucaccaccaucgacaagaacgacaagaucgagaucaacaccggcgaccagaccagcuacaucuacgagaaggacaacagaugcaagaccuggcugugcagagugagagacgagggcaucagcgugaucuucgagccccugaaggccuucuucggcagcuacuucagcaucaucuucuacgugguggugggcaucaucgugcuguuccugaccaucuacaucuuccugcccauguucuucaagcugagagacauccugaagagaaacgaguaccuguaccugcaggagcugaagcacaaguga

SEQ ID NO: 9275 - RNA, 4305 nt, Artificial Sequence
  derived and/or modified CDS sequence (opt4) from MAGV(ts8)__AY286444.1__GP
auggagcugcugaucaucauccugcugcugggcagcgccgccagcagccccaucagcaccagaugcuuccacggcggccagcugaucgccgagagcaagagcgccaccagcaucagcgaguucugccugaaggacgacgugagcaugaucaagagcgaggugaccuacaucaagaacgacaccggcaucuacggccacaacaagguguucagaagcuggaccaucaaggacuggaagcugugcaaccccauccccaccgccggcggcagcaucaacgugaucgaggugaacagcgaccugagccuggccaccagagccuacgugugcagcagagacugcaccaucaccaucgacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagagccugcaguuccacgccugcuucaagcaccacaugagcugcaucagauucuuccaccacaccauccugcccggcaccauggugagcagcaugugccagaacaucgagcugaucaucaucaucggccugacccuggugaucuucauccugauggugauccugaccaagaccuacaucugcuaccugcugaugcccguguucaugcccguggccuacaucuacggcugggccuacaacaagagcugcaagaagugcaacugcugcggccuggccuaccaccccuucaccaacugcggcagccacugcgugugcggccugaaguucgaggccagcgacagaaugagacugcacagagagagcggccugugccagggcuacaagagccugagaaucgccagaaugcugugcaagagcaagggcagcagccuggugaucagcggccugcugagcaugcugcugcugagcuucaucacccccaucgagggcacccugaccaacuaccccaacgagaagcaguacacccuggaggagaucgccgacgugguggagggcaucaucaccgagcagcaccugaaggaguacgugguguucuacaccagccuguucggcggccugauccugcugcugacccugauccugagcaucaccaucaacaaggugaccgaccugcuggccagcaccaacgugaucuacugcgaggagugcagcauguaccacagcaagaagggcaucaaguacaacggcgacuucaccaacaagugcggcuucugcaccugcagcgagcaggaggacguggagggcgugaucauccacaaggugagcagaaagugcaccuacaaguaccagcugaagugggugagagugaucaugaucauccuggcccugcugcugaccauccagaacaccgugcugaucguggccgccgagguggacugcuggaccaagaagagcaucgagaucgacugcaucggcccccugcugaacaucggcagcugcaccgacaagagcagcagaaccuacgagaccgaggugaacaagcuggugagacagagcaaggugacccacgccgacgccgagcagaucagcauccugggcagcacccuggacaacgccaucaaggccgugagaagccagaagaccuacgagaccaugcacuuccuggagaccguguuccugaugaagaacugcgacuacuacaacagcuucgagcacaacagcggcuacagccagaccaaguggagacugaucgccaagaccagccacuucgacaucugcagcagacacagcacccaccacuucugcagaugcgugaacgagggcaccaagugccagaacggcgacugggacuucgccggcgagaugaacgacaccuacaacagcaagaacgacuucuaccugcacgaccuggaccuguucuacacccugcuggagaacgccuuccccggcaccaccgagagccuguucuaccagcugcugcagaagaagaacaccaccggcgccagcaagcugcugggcaagcugaucaccaaguacggcaacaacaacauguucguggagaucuggaaguucggccaguaccugcugaagcugcccuacaucaacgacaccgagcugagcaccgacagaaagagcaccaucaucaagagccagcaggugcugagcagaagccagaccggcagacaggagagccugagcagcgccacccccggcaccgccaccaaggagugcagcaacgccaaggacaucggcugcaucagccccagauucggcauccccaucggcaaccugaccgccugcggcgacagccccaacuacaagguguacaagacccccgagaagaucuacaagagcaacaacagaggcgagguguggugcagcgacgacgugcacugccugaccgacuucgagcccgccgaggaggagguggugaacagaaucaagcagaugaccugcuuccugaccgacgugaccaccaagaccgacguguucagcguggccaucagcaccugcaagaugguggacaagggcgugugcaccgugaacgacgccaaguggaacauccugaagugcaacagcggccuguacuacuucaccgaccacagagacggccaggacaccggcaacgacuucggcgaguacugcaucagccacagcugcaacaccgagagauuccccaucaaccccgacgugcugaaggacugcaucugggaguaccacagcagaaagagcaaguacaucagcaccgugagccuggagagccuggacgaguucagaagagccaugagcgacaagcugagccacacccugaugaucuacaacuucaagcccaccgccaaccugccccacaucaagcccaccuacaaguucaucaccgccaacggcaucgagaacagcgacggcaucgacagcgccuacauccugagcagcauccccgcccugggcggcaugagcgugggcuacaacauccagaccaaggacaacuucccccugcuggacaucaucguguucaucaagagcgccaucaucaagaccaccuacaaccacaucuacgacaccggccccaccaucggcaucaacacccagcacgacgagcacugcaccggccccugccccacccugauccugcacaaggagaacuggcugaccuucagccaggagagaaccagcagauggggcugcgaggaguucggcugccuggccaucaacaccggcugcguguucggcagcugccaggacaucauccaccccgaggccaagguguacagaaaggccaucgaggaggagguggugcugaccgugugcaucaccuuccccggcaacaccuacugcaccgagaucaacgccaucgagcccaagaucaccgacgagaucgagcugcaguucaagaccguggacaccaagacccugcccaaccugcugauggugcagaaccacaagcuguacagcggccagaucgacgaccugggcagcuucagccagggcugcggcaacgugcagaagaccaaccagagcgugaucggcgccggcaccgccaaguucgacuacgugugccacggcgccagcagaaaggacgugaucgugagaagaugcuacaacaacaacuacgagagcugcaagcugcugaaggaggagaccagccugaucuucgccgacaaccacgagacccuggagguggccaacaccaagcaccugaucggcgagcugcaguucaagaucaugcugggcgacaucagauacaagagcuucgccgagagccccgagcuggagguggacgccaagugcgugggcugccccagcugcuucgagagcuacagcugcaacuuccagaucgugaccaacaucgacaccgugugcagcguggacggccccugcacccuguuccacaacagacugaucaucagcgccaccaagcagagcuacggcuucaagaugagcugccccagaaagcccgagcccaccgaggaguuccagaucugcaacagaaaguacaacgugcuguucaccaccaucgacaagaacgacaagaucgagaucaacaccggcgaccagaccagcuacaucuacgagaaggacaacagaugcaagaccuggcugugcagagugagagacgagggcaucagcgugaucuucgagccccugaaggccuucuucggcagcuacuucagcaucaucuucuacgugguggugggcaucaucgugcuguuccugaccaucuacaucuuccugcccauguucuucaagcugagagacauccugaagagaaacgaguaccuguaccugcaggagcugaagcacaaguga

SEQ ID NO: 9276 - RNA, 4311 nt, Artificial Sequence
  derived and/or modified CDS sequence (opt4) from MAGV(AG83-1746)__KX100113.1__GP
augaagaugauccugcugaucaucauccugugcgugaaccuggccgccgccaaccccguggccaccagaugcuuccacggcggccagcugaucgccgagaccagaagcgccaccagcaucagcgaguucugccugaaggacgacgugagcaugaucaagagcgagaucaccuacaccaagaacgacaccggcaucuucggccacagcaagaucuacaagagcuggcugaucaaggacuggaagcugugcaaccccgugcccaccgccggcggcagcaucaacgugaucgaggugaacagcgaccugagccugaccaccaaggccuacgugugcagcagagacugcaccaucaccaucgacaaggaggaggcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucagacaccacaugagcugcgugagauucuuccacaacaccauccugcccggcaccauggugaacagcaugugccagaacaucgagcugaucaucauccugggccugacccugaucaucuucacccugauggugauccugaccaagaccuacaucugcuacauccugaugccccuguucaugcccaucgccuacgccuacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccugaucaucagcacccugcugagcaugcugcugcugagcuucaucacccccaucgagggcaccaugaccaacuaccccgagaccagacaguacagccuggaggagaucgccgacgugguggagggccugcugagcgagcagaacaucaaggaguacgugguguucuacaccagccuguucggcagccugauccugcugcuggccuucauccugagcaucacccugaccaaggugaccaacgcccuggccaagaccaacgugaucuacugcgaggagugcagcauguaccacgccaagaagggcaucaaguacaacggcgacuucaccaacaagugcggcuucugcaccugcgacgagcaggaggacgaggagggcaucaucauccacaaggugagcaagaagugcaccuacagauaccagcugcagugggccaagaucaucaugaucauccuggugaugcugcugaugaugcagaacaccauccugaucguggccgccgagaccgacugcuggaccaagaacagccuggagcuggacugcaucggcccccugcugaccaucagcgacugcagcaacaaggagagcaagaacuacgaggaggaggccgccaagcuggugagccagagcaagaucacccaggccgacgccgagcaggugaccauccugggcaacaccaucgacaccgcccugaaggccaucagaagccagaagaccuaccagaccaugcaccugcuggagagcguguuccugaugaagaacugcgacuacuacagcagcuucgagcacaacagcggcuacagccaggccaaguggagacugaucgccaagaccagccacuucgacaucugcagcagacacagcaugcaccacuucugcagaugcguggccgacggcaccaagugccagaacggcaacugggacuucgccggcgagaugaacaacaccuacagcaccaagaacgacuucuaccugcacgaccugaaccuguucuucacccugcacgagaccgccuuccccggcaccaccgagagccuguucuaccagcugaucgccaagaagaacaccaccggcgccagcaagcugcugggcaagcugaucaccaaguacggcaacaacaagcuguucgugggcaucuggaaguucggccaguaccugcugacccugcccuacgugaacaccaccgagcugagcaagaccagaaaggagaccauccugaagccccaccagauccugaccagaagccagggcggcagacccgagagcaugagcagcgccgaggugggccagaccgccaaggagugcgccaacgccaagaacgugggcugcaucagccccagauucggcgugcccaucggcaaccugaccgccugcggcaacagccccaacuacaagaucuacaagacccccaacaagaucuacaagagcaacaacagaggcgagguguggugcagcgaggacgugcacugccuggccgacuucgagcccgccgacaccgagguggugaacaaggugaagaagaugaccugcuuccugagcgacgugaacaccagagccgacaucuucagcaucgccaucagcgccugcagaaugguggacaagggcgugugcaccgugaacggcgccaaguggaacauccugaagugcgagagcggccuguacuacuucaccgaccacagagagggccaggacaccggcaacgacuucggcgaguacugcaucagccacagcugcaacaccgagagauaccccaucaaccccgacauccugaaggagugcaucugggaguaccacagcagaaagagcaaguacaucagcaccaucaaccuggagagccuggaggaguucaagagagccaugagcgacaagcugagccacacccugaugguguacaacuucaagcccaccgccaaccugccccacaucaagcccagcuacaaguucaucaccgccaacggcaucgagaacagcgacggccuggagagcgccuacauccugagcagcauccccgccaucggcggcaugagcaucggcuacaacauccagaccaaggacaacuucccccugcuggaccugaucguguucgugaagagcgccgugaucaagaccaccuacaaccacaucuacgacaccggccccaccaucggcaucaacaccaaccacgacgagcacugcaccggccccugccccaccaucaucccccacaaggagaacuggcugaccuucagccaggagagaaccagcagauggggcugcgaggaguucggcugccuggccaucaacaccggcugcguguucggcagcugccaggacgugauccaccccgagaccaagaucuacagaaaggccguggaggaggagguggugcugaccgugugcaucaacuuccccggcaacaccuucugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccagagcauccugggcgccggcaccgugaaguucgacuacgugugccacggcgccagcagaaaggacaucaucgugagaagaugcuacaccaacaacuacgacagcugcaagcugcugaaggaggagagaagccugaucuucgccgacaaccacgagacccuggagguggccaacaccagacaccugaucggcgagcugcaguucaagaucaugcugggcgacaucagauacaaggccuucgccgagaagcccgagcuggagaucgacgccaagugcgugggcugccccagcugcuucgagagcuacagcugcagcuuccagaucgugaccagcaucgacaccgugugcagcguggagggccccugcacccuguuccacaacagaaucaucaucaccgccgccaagcagagcuacggcgugaagaugagcugcaagaccaagcccggccccguggaggaguucagaaucugcaacagaaacuacagagugagcuucgccaccaucgacaagaacgacaagaucgagaucaacaccggcgaccagaccagcuacaucguggagaaggacagcagaugcaagaccuggcugugcagagugagagacgagggcaucagcgugaucuucgagccccugaaggccuucuucggcagcuacuucagcguggccuucuacaucaucaucggcaucgccgcccuguuccugaucaucuacaucuuccugcccauguucuucaagcugagagacgugcugaagaagaacgaguaccuguaccugcaggagcugaagcacaaguga

SEQ ID NO: 9277 - RNA, 4305 nt, Artificial Sequence
  derived and/or modified CDS sequence (opt4) from MAGV(BeAr 7272)__KX100104.1__GP
auggagcugcugaucaucauccugcugcugggcagcgccgccagcagccccaucagcaccagaugcuuccacggcggccagcugaucgccgagagcaagagcgccaccagcaucagcgaguucugccugaaggacgacgugagcaugaucaagagcgaggugaccuacaucaagaacgacaccggcaucuacggccacaacaagguguucagaagcuggaccaucaaggacuggaagcugugcaaccccauccccaccgccggcggcagcaucaacgugaucgaggugaacagcgaccugagccuggccaccagagccuacgugugcagcagagacugcaccaucaccaucgacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagagccugcaguuccacgccugcuucaagcaccacaugagcugcaucagauucuuccaccacaccauccugcccggcaccauggugagcagcaugugccagaacaucgagcugaucaucaucaucggccugacccuggugaucuucauccugauggugauccugaccaagaccuacaucugcuaccugcugaugcccguguucaugcccguggccuacaucuacggcugggccuacaacaagagcugcaagaagugcaacugcugcggccuggccuaccaccccuucaccaacugcggcagccacugcgugugcggccugaaguucgaggccagcgacagaaugagacugcacagagagagcggccugugccagggcuacaagagccugagaaucgccagaaugcugugcaagagcaagggcagcagccuggugaucagcggccugcugagcaugcugcugcugagcuucaucacccccaucgagggcacccugaccaacuaccccaacgagaagcaguacacccuggaggagaucgccgacgugguggagggcaucaucaccgagcagcaccugaaggaguacgugguguucuacaccagccuguucggcggccugauccugcugcugacccugauccugagcaucaccaucaacaaggugaccgaccugcuggccagcaccaacgugaucuacugcgaggagugcagcauguaccacagcaagaagggcaucaaguacaacggcgacuucaccaacaagugcggcuucugcaccugcagcgagcaggaggacguggagggcgugaucauccacaaggugagcagaaagugcaccuacaaguaccagcugaagugggugagagugaucaugaucauccuggcccugcugcugaccauccagaacaccgugcugaucguggccgccgagguggacugcuggaccaagaagagcaucgagaucgacugcaucggcccccugcugaacaucggcagcugcaccgacaagagcagcagaaccuacgagaccgaggugaacaagcuggugagacagagcaaggugacccacgccgacgccgagcagaucagcauccugggcagcacccuggacaacgccaucaaggccgugagaagccagaagaccuacgagaccaugcacuuccuggagaccguguuccugaugaagaacugcgacuacuacaacagcuucgagcacaacagcggcuacagccagaccaaguggagacugaucgccaagaccagccacuucgacaucugcagcagacacagcacccaccacuucugcagaugcgugaacgagggcaccaagugccagaacggcgacugggacuucgccggcgagaugaacgacaccuacaacagcaagaacgacuucuaccugcacgaccuggaccuguucuacacccugcuggagaacgccuuccccggcaccaccgagagccuguucuaccagcugcugcagaagaagaacaccaccggcgccagcaagcugcugggcaagcugaucaccaaguacggcaacaacaacauguucguggagaucuggaaguucggccaguaccugcugaagcugcccuacaucaacgacaccgagcugagcaccgacagaaagagcaccaucaucaagagccagcaggugcugagcagaagccagaccggcagacaggagagccugagcagcgccacccccggcaccgccaccaaggagugcagcaacgccaaggacaucggcugcaucagccccagauucggcauccccaucggcaaccugaccgccugcggcgacagccccaacuacaagguguacaagacccccgagaagaucuacaagagcaacaacagaggcgagguguggugcagcgacgacgugcacugccugaccgacuucgagcccgccgaggaggagguggugaacagaaucaagcagaugaccugcuuccugaccgacgugaccaccaagaccgacguguucagcguggccaucagcaccugcaagaugguggacaagggcgugugcaccgugaacgacgccaaguggaacauccugaagugcaacagcggccuguacuacuucaccgaccacagagacggccaggacaccggcaacgacuucggcgaguacugcaucagccacagcugcaacaccgagagauuccccaucaaccccgacgugcugaaggacugcaucugggaguaccacagcagaaagagcaaguacaucagcaccgugagccuggagagccuggacgaguucagaagagccaugagcgacaagcugagccacacccugaugaucuacaacuucaagcccaccgccaaccugccccacaucaagcccaccuacaaguucaucaccgccaacggcaucgagaacagcgacggcaucgacagcgccuacauccugagcagcauccccgcccugggcggcaugagcgugggcuacaacauccagaccaaggacaacuucccccugcuggacaucaucguguucaucaagagcgccaucaucaagaccaccuacaaccacaucuacgacaccggccccaccaucggcaucaacacccagcacgacgagcacugcaccggccccugccccacccugaucccccacaaggagaacuggcugaccuucagccaggagagaaccagcagauggggcugcgaggaguucggcugccuggccaucaacaccggcugcguguucggcagcugccaggacaucauccaccccgaggccaagguguacagaaaggccaucgaggaggagguggugcugaccgugugcaucaccuuccccggcaacaccuacugcaccgagaucaacgccaucgagcccaagaucaccgacgagaucgagcugcaguucaagaccguggacaccaagacccugcccaaccugcugauggugcagaaccacaagcuguacagcggccagaucaacgaccugggcagcuucagccagggcugcggcaacgugcagaagaccaaccagagcgugaucggcgccggcaccgccaaguucgacuacgugugccacggcgccagcagaaaggacgugaucgugagaagaugcuacaacaacaacuacgagagcugcaagcugcugaaggaggagaccagccugaucuucgccgacaaccacgagacccuggagguggccaacaccaagcaccugaucggcgagcugcaguucaagaucaugcugggcgacaucagauacaagagcuucgccgagagccccgagcuggagguggacgccaagugcgugggcugccccagcugcuucgagagcuacagcugcaacuuccagaucgugaccaacaucgacaccgugugcagcguggacggccccugcacccuguuccacaacagacugaucaucagcgccaccaagcagagcuacggcuucaagaugagcugccccagaaagcccgagcccaccgaggaguuccagaucugcaacagaaaguacaacgugcuguucaccaccaucgacaagaacgacaagaucgagaucaacaccggcgaccagaccagcuacaucuacgagaaggacaacagaugcaagaccuggcugugcagagugagagacgagggcaucagcgugaucuucgagccccugaaggccuucuucggcagcuacuucagcaucaucuucuacgugguggugggcaucaucgugcuguuccugaccaucuacaucuuccugcccauguucuucaagcugagagacauccugaagagaaacgaguaccuguaccugcaggagcugaagcacaaguga

SEQ ID NO: 9278 - RNA, 4311 nt, Artificial Sequence
  derived and/or modified CDS sequence (opt4) from MAGV(CbaAr 426)__KX100110.1__GP
augaagaugauccugcugaucaucauccugugcgugaaccuggccgccgccaaccccguggccaccagaugcuuccacggcggccagcugaucgccgagaccagaagcgccaccagcaucagcgaguucugccugaaggacgacgugagcaugaucaagagcgagaucaccuacaccaagaacgacaccggcaucuucggccacagcaagaucuacaagagcuggcugaucaaggacuggaagcugugcaaccccgugcccaccgccggcggcagcaucaacgugaucgaggugaacagcgaccugagccugaccaccaaggccuacgugugcagcagagacugcaccaucaccaucgacaaggaggaggcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucagacaccacaugagcugcgugagauucuuccacaacaccauccugcccggcaccauggugaacagcaugugccagaacaucgagcugaucaucauccugggccugacccugaucaucuucacccugauggugauccugaccaagaccuacaucugcuacauccugaugccccuguucaugcccaucgccuacgccuacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccugaucaucagcacccugcugagcaugcugcugcugagcuucaucacccccaucgagggcaccaugaccaacuaccccgagaccagacaguacagccuggaggagaucgccgacgugguggagggccugcugagcgagcagaacaucaaggaguacgugguguucuacaccagccuguucggcagccugauccugcugcuggccuucauccugagcaucacccugaccaaggugaccaacgcccuggccagaaccaacgugaucuacugcgaggagugcagcauguaccacgccaagaagggcaucaaguacaacggcgacuucaccaacaagugcggcuucugcaccugcgacgagcaggaggacgaggagggcaucaucauccacaaggugagcaagaagugcaccuacagauaccagcugcagugggccaagaucaucaugaucauccuggugaugcugcugaugaugcagaacaccauccugaucguggccgccgagaccgacugcuggaccaagaacagccuggagcuggacugcaucggcccccugcugaccaucagcgacugcagcaacaaggagagcaagaacuacgaggaggaggccgccaagcuggugagccagagcaagaucacccaggccgacgccgagcaggugaccauccugggcaacaccaucgacaccgcccugaaggccaucagaagccagaagaccuaccagaccaugcaccugcuggagagcguguuccugaugaagaacugcgacuacuacagcagcuucgagcacaacagcggcuacagccaggccaaguggagacugaucgccaagaccagccacuucgacaucugcagcagacacagcaugcaccacuucugcagaugcguggccgacggcaccaagugccagaacggcgacugggacuucgccggcgagaugaacaacaccuacagcaccaagaacgacuucuaccugcacgaccugaaccuguucuucacccugcacgagaccgccuuccccggcaccaccgagagccuguucuaccagcugaucgccaagaagaacaccaccggcgccagcaagcugcugggcaagcugaucaccaaguacggcaacagcaagcuguucgugggcaucuggaaguucggccaguaccugcugacccugcccuacgugaacaccaccgagcugagcaagaccagaagagagaccauccugaagacccaccagauccugaccagaagccagggcggcagaagcgagagcaugagcagcgccgaggugggccagaucgccaaggagugcgccaacgccaagaacgugggcugcaucagccccagauucggcauccccaucggcaaccugaccgccugcggcaacagccccaacuacaagaucuacaagacccccaacaagaucuacaagagcaacaacagaggcgagguguggugcagcgaggacgugcacugccuggccgacuucgagcccgccgacaccgagguggugaacaaggugaagaagaugaccugcuuccugagcgacgugaacaccagagccgacaucuucagcaucgccaucagcgccugcagaaugguggacaagggcgugugcaccgugaacggcgccaaguggaacauccugaagugcgagagcggccuguacuacuucaccgaccacagagagggccaggacaccggcaacgacuucggcgaguacugcaucagccacagcugcaacaccgagagauaccccaucaaccccgacauccugaaggagugcaucugggaguaccacagcagaaagagcaaguacaucagcaccaucaaccuggagagccuggaggaguucaagagagccaugagcgacaagcugagccacacccugaugguguacaacuucaagcccaccgccaaccugccccacaucaagcccagcuacaaguucaucaccgccaacggcaucgagaacagcgacggccuggagagcgccuacauccugagcagcauccccgccaucggcggcaugagcaucggcuacaacauccagaccaaggacaacuucccccugcuggaccugaucguguucgugaagagcgccgugaucaagaccaccuacaaccacaucuacgacaccggccccaccaucggcaucaacaccaaccacgacgagcacugcaccggccccugccccaccaucaucccccacaaggagaacuggcugaccuucagccaggagagaaccagcagauggggcugcgaggaguucggcugccuggccaucaacaccggcugcguguucggcagcugccaggacgugauccaccccgagaccaagaucuacagaaaggccguggaggaggagguggugcugaccgugugcaucaacuuccccggcaacaccuucugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccagagcauccugggcgccggcaccgugaaguucgacuacgugugccacggcgccagcagaaaggacaucaucgugagaagaugcuacaccaacaacuacgacagcugcaagcugcugaaggaggagagaagccugaucuucgccgacaaccacgagacccuggagguggccaacaccagacaccugaucggcgagcugcaguucaagaucaugcugggcgacaucagauacaaggccuucgccgagaagcccgagcuggagaucgacgccaagugcgugggcugccccagcugcuucgagagcuacagcugcaacuuccagaucgugaccagcaucgacaccgugugcagcguggagggccccugcacccuguuccacaacagaaucaucaucaccgccgccaagcagagcuacggcgugaagaugagcugcaagaccaagcccggccccguggaggaguucaccaucugcaacagaaacuacagagugagcuucgccaccaucgacaagaacgacaagaucgagaucaacaccggcgaccagaccagcuacaucguggagaaggacagcagaugcaagaccuggcugugcagagugagagacgagggcaucagcgugaucuucgagccccugaaggccuucuucggcagcuacuucagcaucgccuucuacaucaucaucggcaucgccgcccuguuccugaucaucuacaucuuccugcccauguucuucaagcugagagacgugcugaagaagaacgaguaccuguaccugcaggagcugaagcacaaguga

SEQ ID NO: 9279 - RNA, 4305 nt, Artificial Sequence
  derived and/or modified CDS sequence (opt4) from MAGV(CoAr 3363)__KX100107.1__GP
augcugagccugcugauccuggccuuccugggccugagcaccagcaaccccaucgccaccagaugcuuccacggcggccagcugaucgccgagagcaagagcgccaccagcaucagcgaguucugccugaaggacgacgugagcaugcugaagagcgaggugguguacaccaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccagaagaaacgugaucuacugcgaggagugcagcauguaccacagcaagagaggcaucaaguacaacggcgacuucaccaacaagugcggcuucugcaccugcaacgagcaggaggacgccgagggccuggugauccacaaggugagcaagagaugcaccuacaagugccagcugaagugggccaaggugcugaugaucacccuggugcugcugcugaucgcccagaacaccauccugaucguggccgccaagaccgacugcuggaccaagaagagccuggacaucgacugcaucggccccaugcuggacaucggcagcugcaccaacaagaacaccagaagcuacgacaccgaggcccagaagcuggugacccagagcaaggugagccagcuggacgccgaccaggccagccugcugggcagcagcaucgacagcgccaucaaggccaucagaacccagaagaccuaccccaccaugcaccugcuggagaccaucuuccugaugaagaacugcgacuacuacaccagcuucaaccacaacagcggcuacagccaggccagauggagacugaucgccaagaccggccacuucgacaucugcagcagacacagcacccaccacuucugcagaugcaucagcgacggcaccaagugccagaacggcgacugggacuucgccggcgagaugaacgagcccuacaacagcaagaacgacuucuaccugcacgaccugaaccuguucuacaccaucuucgagaacgccuuccccggcaccaccgagagccuguucuaccagcugauccagaagagagacaccaccggcgccagcaaggugcugggcaagcugaucaccaaguacggcaacaacaacauguucgugggcguguggaaguucggccaguaccugcugacccugcccuacaucaacaacaccgagcugagccagaacagaaagcagaccauccuggccacccaggagccccugagcagaagccaccccggcagacaggagagcaugagcagcgccauccagggcagcgugaccaaggagugccacaacgccaaggacgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaaggugaagaagcugaccugcuuccugaccgacgugcuggugaagaccgacaucuucagcguggccgccagcaccugcaagauggccgacaagggcaucugcaccgugaacgacgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugagcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaucaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgccaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacguggugaucggcaucaucgugcuguuccugaucguguacaucuuccugcccauguucuucaagcugaaggacgugcugaagaagaacgaguaccuguaccugcaggagcugaagcacaaguga

SEQ ID NO: 9280 - RNA, 4305 nt, Artificial Sequence
  derived and/or modified CDS sequence (opt4) from MAGV(OBS 6657)__KX100116.1__GP
auggagcugcugaucaucauccugcugcugggcagcgccgccagcagccccgugagcaccagaugcuuccacggcggccagcugaucgccgagagcaagagcgccaccagcaucagcgaguucugccugaaggacgacgugagcaugaucaagagcgaggugaccuacaccaagaacgacaccggcaucuacggccacaacaagguguucagaagcuggaccaucaaggacuggaagcugugcaaccccauccccaccgccggcggcagcaucaacgugaucgaggugaacagcgaccugagccuggccaccaaggccuacgugugcagcagagacugcaccaucaccaucgacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagagccugcaguuccacgccugcuucaagcaccacaugagcugcaucagauucuuccaccacaccauccugcccggcaccauggugagcagcaugugccagaacaucgagcugaucaucaucaucggccugacccuggugcuguucauccugauggugauccugaccaagaccuacaucugcuaccugcugaugcccaucuucaugcccaucgccuacaucuacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagaaugcugugcaagagcaagggcagcagccuggugaucagcggccugcugagcaugcugcugcugagcuucaucacccccaucgagggcacccugaccaacuaccccaacgagagacaguacacccuggaggagaucgccgacgugguggagggcauccugaccgagcagcaccugaaggaguacgugguguucuacaccagccuguucggcggccugauccugcugcugacccugauccugagcaucaccaucaacaaggugaccgaccugcuggccagcaccaacgugaucuacugcgaggagugcagcauguaccacagcaagaagggcaucaaguacaacggcgacuucaccaacaagugcggcuucugcaccugcagcgagcaggaggacaucgagggcguggugauccacaaggugagcagaaagugcaccuacaaguaccagcugaagugggugagagugaucaugaucauccuggcccugcugcugacccugcagaacaccgugcugaucguggccgccgagguggacugcuggaccaagaagagcaucgagaucgacugcaucggcccccugcugaacaucggcaccugcaccgacaagagcagcagaaccuacgagaccgaggugaacaagcuggugagacagagcaaggugacccaggccgacgccgagcaggugagcauccugggcagcacccuggacagcgccaucaaggccaucagaagccagaagaccuacgagaccaugcacuuccuggagaccguguuccugaugaagaacugcgacuacuacagcagcuucgagcacaacagcggcuacagccagaccaaguggagacugaucgccaagaccagccacuucgacaucugcagcagacacagcgcccaccacuucugcagaugcgugaacgagggcaccaagugccagaacggcgacugggacuucgccagagagaugaacgacaccuacaacagcaagaacgacuucuaccugcacgaccuggaccuguucuacacccuguucgagaacgccuuccccggcaccaccgagagccuguucuaccagcugcugcagaagaagaacaccaccggcgccagcaagcugcugggcaagcugaucaccaaguacggcaacaacaaccuguucgugggcaucuggaaguucggccaguaccugcugaagcugcccuacaucaacgacaccgagcugagcaccgacagaaagagcaccaucaugaagagccagcagaugcugagcagaagccagaccggcagacaggagagccugagcagcgccacccccggcaccgccaccaaggagugcagcaacgccaaggacaucggcugcaucagccccagauucggcauccccaucggcaaccugaccgccugcggcgacagccccaacuacaagaucuacaagacccccgagaagaucuacaagagcaacaacaagggcgagguguggugcagcgacgacgugcacugccuggccgacuucgagcccgccgaggaggagguggugaacagaaucaagcagaugaccugcuuccugaccgacgugaccaccaagaccgacguguucagcguggccaucagcaccugcaagauggccgacaagggcgugugcaccgugaacgacgccaaguggaacauccugaagugcaacagcggccuguacuacuucaccgaccacagagacggccaggacaccggcaacgacuucggcgaguacugcaucagccacagcugcaacaccgagagauuccccaucaaccccgacgugcugaaggacugcaucugggaguaccacagcagaaagagcaaguacaucagcaccaucagccuggagagccuggacgaguucagaagagccaugagcgacaagcugagccacacccugaugaucuacaacuucaagcccaccgccaaccugccccacaucaagcccaccuacaaguucaucaccgccaacggcaucgagaacagcgacggcaucgacagcgccuacauccugagcagcauccccgcccugggcggcaugagcgugggcuacaacgugcagaccaaggacaacuucccccugcuggacaucaucguguucaucaagagcgccaucaucaagaccaccuacaaccacaucuacgacaccggccccaccaucggcaucaacacccagcacgacgagcacugcaccggccccugccccacccugaucccccacaaggagaacuggcugaccuucagccaggagagaaccagcagauggggcugcgaggaguucggcugccuggccaucaacaccggcugcguguucggcagcugccaggacaucauccaccccgaggccaagguguacagaaaggccaucgaggaggagguggugcugaccgugugcaucaccuuccccggcaacaccuacugcaccgagaucaacgccaucgagcccaagaucaccgacgagaucgagcugcaguucaagaccguggacaccaagacccugcccaaccugcugauggugcagaaccacaagcuguacagcggccagaucaacgaccugggcagcuucagccagggcugcggcaacgugcagaagaccaaccagagcgugaucggcaccggcaccgccaaguucgacuacgugugccacggcgccagcagaaaggacgugaucgugagaagaugcuacaacaacaacuacgagagcugcaagcugcugaaggaggagagcagccugaucuucgccgacaaccacgagacccuggagguggccaacaccaagcaccugaucggcgagcugcaguucaagaucaugcugggcgacaucagauacaagagcuucgccgagagccccgagcuggagguggacgccaagugcgugggcugccccagcugcuucgagagcuacagcugcaacuuccagaucgugaccaacaucgacaccgugugcagcguggacggccccugcacccuguuccacaacagacugaucaucagcgccgccaagcagagcuacggccugaagaugagcugcagcagaagacccgagcagaccgaggaguuccagaucugcaacagaaaguacagcgugcuguucaccaccaucgacaagaacgacaagaucgagaucaacaccggcgaccagaccagcuacaucuacgagaaggacaacagaugcaagaccuggcugugcagagugagagacgagggcaucagcgugaucuucgagccccugaaggccuucuucggcagcuacuucagcaucaucuucuacgugaucgugggcaucaucgugcuguuccugaucaucuacaucuuccugcccauguucuucaagcugagagacauccugaagagaaacgaguaccuguaccugcaggagcugaagcacaaguga

SEQ ID NO: 9281 - RNA, 4302 nt, Artificial Sequence
  derived and/or modified CDS sequence (opt4) from NORV(0234)__EU004188.1__GP
augaucugguucauccugcugcuggccaucgcccccagcuucggcacccccaucgccaccagaugcuuccacggcggccagcugaucgccgaggccaagagccagaccagcaucagcgaguucugccugaaggacgacgugagcaugaucaagagcgaggugaccuacaccaagaacgacaccggcaucuucggccacagcaagguguacagaagcuggaccaucaaggacuggaagcugugcaaccccgugcccaccgugggcggcagcaucaacgugaucgaggugaccgccgaccugagccugagcaccaaggccuacgugugcagcagagacugcaccaucaccaucgacaaggagggcgcccagaucguguuccagaccgacaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacaacaccauccugcccggcagcaugguggccagcaugugccagaacaucgagcugaucaucauccugggccugacccugaucaucuucauccugauggccauccugaccaagaccuacaucugcuaccugcugaugcccaucuucaugcccaucgccuacgccuacggcugggccuacaacaagagcugcaagaagugccacugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccuggugaucagcauccugcugagcaugcugauccugagcuucgugacccccaucgagggcacccugaccaacuaccccgagagcagaagauacacccuggaggagaucgccgacgugguggagggcaucaucgccgagcaggaccugaaggaguacaucguguucuacaccagccuguucggcagccugauccugcugcuggccuucauccugagcgugacccugaccaaggugcuggaccugcuggccaagaccaacgugaucuacugcgaggagugcagcauguaccaccccagaaagggcaucaaguacaacggcgacuucaccaacaagugcggcuucugcaccugcgacgagcaggaggacguggagggcgugaucauccacaaggugagcaagaagugcaccuacagauaccaggugaagugggccaagaucaucaugaucaucguggugauccugcugauggcccagaacaccauccugaucguggccgccgagaccgacugcuggaccaagaagagccuggagcuggacugcaucggcccccugcugaacaucggcagcugcagcggcaaggaggccagaaccuacgagaccgaggugaagaagcuggugagccagagcaaggugacccacaucgacgccgagcacaucagcauccugggcgccaccaucgacagcgccaucaagagcaucagagcccagaagaccuacgccaccaugcaccugcuggagaccguguuccugaugaagaacugcgacuacuacaccguguucgagcacaacagcggcuacagccaggccaaguggagacugaucgccaagaccaaccacuucgacaucugcagcagacacagcgcccaccacuucugcagaugcaucaacgacgagaccaagugccagaacggcaacugggacuucgccggcgagaugaacaacaccuacagcaccaagaaggacuucuacagacacgaccuggaccuguucuacaccaucuucgagaacgccuuccccggcagcaccgagagccuguucuaccaccugcugcagaccaagaacaccaccggcgccagcagaauccuggagaagcugagcaccaaguucggcaacaacaacauguucgugggcaucuggaaguucggccaguaccugcugacccugcccuacgugaacgagaccgagcugagccccagcagacagagcaccauccugaccaacagcaacagccugagcagaagcaccggcagacaggagagccugagcagcgccauccccggccccaacaccaaggagugcagcaacgccagagacgugggcugcaucagccccagauucggcauccccaucggcaaccugaccgccugcggcgagagccccagcuacaagaucuacaagacccccgagaagcuguacaagagcaacaacaagggcgagaucuggugcagcgacgacgugcacugccugaagaacuucgagcccgccaccgaggagaucgugaacagaaucaagcagaugaccugcuuccugaccgacgugagcaccaagaccgacaucuucagcaucgccaccagcaccugcagaaugguggacaagggcgugugcaccgugaacgacgccaaguggaacauccugaagugcgacagcggccuguucuacuucaccgaccagagagagggccaggacaccggcaacgacuucggcgaguacugcaucagccacagcugcaacaccgagagauuccccaucaaccccgacauccugaaggacugcaccugggaguaccacagcagaaagagcaaguacaucagcaccaucagccuggagagccuggacgaguucagaagagccaugagcgacaagcugagccacacccugaugaucuacaacuucaagcccaccgccaaccugccccacaucaagcccaccuacaaguucaucaccgccaacggcaucgagaacagcgacggccuggacagcgccuacaucgugagcagcauccccgcccugggcggcaugagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggcgccugccccacccagaucccccacaaggacaacuggcugaccuucagccaggagagaaccagcagauggggcugcgaggaguucggcugccuggccaucaacaccggcugcguguucggcagcugccaggacaucauccaccccgagaccaagguguacagaaaggccauggaggaggaggugauccugaccgugugcgugaccuuccccggcaacaccuacugcaccgagaucaacgccaucgagcccaagaucaccgacgagaucgagcugcaguucaagaccguggacaccaagacccugcccaacauccuggccgugcagaaccacaagcuguacagcggccagaucaacgaccugggcagcuucagccagggcugcggcaacgugcagaagaccaaccagagcauccugggcaccggcaccgccaaguucgacuacgugugccacggcgccagcagaaaggacaucaucgugagaagaugcuacaacaacaaccacgacagcugcaagcugcugaaggaggagaccagccugaucuucgccgacaaccacgagacccuggugguggccaacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucaucaccaacaucgacaccgugugcagcgugagcggccccugcacccuguuccacaacagacugaucaucaccgccaccaagcagagcuacggcaucaagaugagcugccccaccaagcccgagggcaccgagaccuucgagaucugcaacaagcaguacaagaucuucuucaccaccaucgacaagaacgacaagaucgagaucaacaccggcgaccagaccagcuacaucuacgagaaggacaacagaugcaagaccuggcugugcagagugagagacgagggcaucagcgugcuguucgagccccugagagccuucuucggcagcuacuucagcaucaucuucuacgccguggugggcaucaucauccuguuccuggccguguacaucuuccugcccaugaucuucaagcugagagacaugcugaagaagaacgaguaccuguaccugcaggagagcaagcacaaguga

SEQ ID NO: 9282 - RNA, 4305 nt, Artificial Sequence
  derived and/or modified CDS sequence (opt4) from PLAV(75V3066)__KX100122.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaucaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugagcagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccaagagaaacgugaucuacugcgaggagugcagcauguaccacagcaagagaggcaucaaguacaacggcgacuucaccaacaagugcggcuucugcaccugcaacgagcaggaggacaccgagggccuggugauccacaaggugagcaagagaugcaccuacaaguaccagcugaagugggccaaggugcugaugaucacccuggugcugcugcugaucgcccagaacaccauccugaucguggccgccgagaccgacugcuggaccaagaagagccuggacaucgacugcaucggccccaugcuggacaucggcagcugcaccaacaagaacaccagaagcuacgacgccgaggcccagaagcuggugagccagagcaagaucagccagcuggacgccgaccaggugagccugcugggcaacagcaucgacagcgccaucaaggccaucagagcccagaagaccuaccccaccaugcaccugcuggagaccaucuuccugaugaagaacugcgacuacuacaccaacuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaaggugcugggcaagcugaucaccaaguacggcaacaacaacauguucgugggcguguggaaguucggccaguaccugcugacccugcccuacaucaacaacaccgagcugagccagaacagaagacugaccauccuggccacccaggagauccugagcagaagccacagcggcagacaggagagcaugagcaacgccauccagggcagcaucaccaaggagugccacaacgccaagggcgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggaggugaucaacaagaucaagaagcugaccugcuuccugaccgacgugagcguggagguggacaucuucagcguggccgccagcaccugcaagauggccgacaagggcgugugcaccgugaacggcgccaaguggaacaucaucaagugcgacagcggccuguacuacuucaccgaccacagagagggccaggacaccggcaacgacuucggcgaguacugcaucagccacagcugcaacaccgagagauuccccaucaaccccgacacccugaaggacugcaccugggaguuccacagcagaaagagcaaguacaucagcaccaucagccuggagagccuggaggaguucagaagagccauggccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaugaccuucagccaggagagaaccagcagauggggcugcgaggaguucggcugccuggccaucaacaccggcugcguguucggcagcugccaggacaucauccaccccgagaccaagguguacagaaaggccguggaggaggagguggugcugaccgugugcaucaacuuccccggcaacagcuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgugaaguucgacuacgugugccacggcgccagcagaaaggacgugaccgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucguguacaucuuccugcccauguucuucaagcugaaggacgugcugaagagaaacgaguaccuguaccugcaggagcugaagcacaaguga

SEQ ID NO: 9283 - RNA, 4305 nt, Artificial Sequence
  derived and/or modified CDS sequence (opt4) from PLAV(75V5758)__KX100128.1__GP
auggagcugcugaucaucauccugcugcugggcagcgccgccagcagccccgugagcaccagaugcuuccacggcggccagcugaucgccgagagcagaagcgccaccagcaucagcgaguucugccugaaggacgacgugagcaugaucaagagcgaggugaccuacaccaagaacgacaccggcaucuacggccacaacaagguguucagaagcuggaccaucaaggacuggaagcugugcaaccccauccccaccgccggcggcagcaucaacgugaucgaggugaacagcgaccugagccuggccaccaaggccuacgugugcagcagagacugcaccaucaccaucgacaaggaggacgcccagaucaucuuccagaccgacaagcugaaccacuucgaggugagcggcaccacccugagcagcggcugguucaagaccaaggccagcgugacccuggacagaaccugcgagcacaucaaggugaccugcggcaagaagagccugcaguuccacgccugcuucaagcaccacaugagcugcaucagauucuuccaccacaccauccugcccggcaccauggugagcagcaugugccagaacaucgagcugaucaucaucaucggccugacccuggccaucuucauccugauggugauccugaccaagaccuacaucugcuaccugcugaugcccguguucaugcccaucgccuacaucuacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagaaugcugugcaagagcaagggcagcagccuggugaucagcggccugcugagcaugcugcugcugagcuucaucacccccaucgagggcacccugaccaacuaccccaacgagaagcaguacacccuggaggagaucgccgacgugguggagggcaucaugaccgagcagcaccugaaggaguacgugguguucuacaccagccuguucggcggccugauccugcugcugacccugauccugagcaucaccaucaacaaggugaccgaccugcuggccagcaccaacgugaucuacugcgaggagugcagcauguaccacagcaagaagggcaucaaguacaacggcgacuucaccaacaagugcggcuucugcaccugcagcgagcaggaggacguggagggcguggugauccacaaggugagcagaaagugcaccuacaaguaccagcugaagugggugagagugaucaugaucauccuggcccugcugcugaccauccagaacaccgugcugaucguggccgccgagguggacugcuggaccaagaagagcaucgagaucgacugcaucggcccccugcugaacaucggcagcugcaccgacaagagcggcaagaccuacgagaccgaggugaacaagcuggugagacagagcaaggugacccaggccgacgccgagcagaucagcgugcugggcaacacccuggacagcgccaucaaggccaucagaagccagaagaccuacgagaccaugcacuuccuggagaccguguuccugaugaagaacugcgacuacuacagcagcuucgagcacaacagcggcuacagccagaccaaguggagacugaucgccaagaccagccacuucgacaucugcagcagacacagcgcccaccacuucugcagaugcgugaacgagggcaccaagugccagaacggcgacugggacuucgccggcgagaugaacaacaccuacaacagcaagaacgacuucuaccugcacgaccuggaccuguucuacacccuguucgagaacgccuuccccggcaccaccgagagccuguucuaccagcugcugcagaagaagaacaccaccggcgccagcaagcugcugggcaagcugaucaccaaguacggcaacaacaacauguucgugggcaucuggaaguucggccaguaccugcugaagcugcccuacaucaacgacaccgagcugagcgccgacagaaagagcaccaucaugaagagccagcaggugcugagcagaagccagaccggcagacaggagagccugagcagcgccacccccggcaccgccaccaaggagugcagcaacgccaaggacaucggcugcaucagccccagauucggcauccccaucggcaaccugaccgccugcggcgacagccccaacuacaagaucuacaagacccccgagaagaucuacaagagcaacaacaagggcgagguguggugcagcgacgacgugcacugccuggccgacuucgagcccgccgaggaggagguggugaacagaaucaagcagaugaccugcuuccugaccgacgugaccaccaagaccgacguguucagcaucgccgugagcaccugcaagaugguggacaagggcgugugcaccgugaacgacgccaaguggaacauccugaagugcaacagcggccuguacuacuucaccgaccacagagacggccaggacaccggcaacgacuucggcgaguacugcaucagccacagcugcaacaccgagagauuccccaucaaccccgacgugcugaaggacugcaucugggaguaccacagcagaaagagcaaguacaucagcaccaucagccuggagagccuggacgaguucagaagagccaugagcgacaagcugagccacacccugaugaucuacaacuucaagcccaccgccaaccugccccacaucaagcccgccuacaaguucaucaccgccaacggcaucgagaacagcgacggcaucgacagcgccuacauccugagcagcauccccgcccugggcggcaugagcgugggcuacaacgugcagaccaaggacaacuucccccugcuggacaucaucguguucaucaagagcgccaucaucaagaccaccuacaaccacaucuacgacaccggccccaccaucggcaucaacacccagcacgacgagcacugcaccggccccugccccacccugaucccccacaaggagaacuggcugaccuucagccaggagagaaccagcagauggggcugcgaggaguucggcugccuggccaucaacaccggcugcguguucggcagcugccaggacaucauccaccccgaggccaagguguacagaaaggccaucgaggaggagguggugcugaccgugugcaucaccuuccccggcaacaccuacugcaccgagaucaacgccaucgagcccaagaucaccgacgagaucgagcugcaguucaagaccguggacaccaagacccugcccaaccugcugauggugcacaaccacaagcuguacagcggccagaucaacgaccugggcagcuucagccagggcugcggcaacgugcagaagaccaaccagagcgugaucggcgccggcaccgugaaguucgacuacgugugccacggcgccagcagaaaggacgugaucgugagaagaugcuacaacaacaacuacgagagcugcaagcugcugaaggaggagaccagccugaucuucgccgacaaccacgagacccuggagguggccaacaccaagcaccugaucggcgagcugcaguucaagaucaugcugggcgacaucagauacaagagcuucgccgagagccccgagcuggagguggacgccaagugcgugggcugccccagcugcuucgagagcuacagcugcaacuuccagaucgugaccaacaucgacaccgugugcagcgugaacggccccugcacccuguuccacaacagacugaucaucagcgccaccaagcagagcuacggccugaagaugagcugcagcagaaagcccgagcccaccgaggaguuccagaucugcaacagaaaguacagcgugcuguucaccaccaucgacaagaacgacaagaucgagaucaacaccggcgaccagaccagcuacaucuacgagaaggacaacagaugcaagaccuggcugugcagagugagagacgagggcaucagcgugaucuucgagccccugaaggccuucuucggcagcuacuucagcaucaucuucuacgugaucgugggcaucaucgugcuguuccugaucguguacaucuuccugcccauguucuucaagcugagagacauccugaagagaaacgaguaccuguaccugcaggagcugaagcacaaguga

SEQ ID NO: 9284 - RNA, 4317 nt, Artificial Sequence
  derived and/or modified CDS sequence (opt4) from POTV(89-3380)__EU004189.1__GP
auggagccccccaugaagcuguuccugauccuggccaccgccguggccgccguguacagccugcccgccagcagaugcuucagcgacggcaucaucaucaaggagaagcaggacagcaaggccgugagcgaguucugccugaaggacgacgugagcaugaucaagagccacgugguguacagcaagaacgagagcggcaucuucgccaacagccagauccugagaaaguggaucaucaaggacuggaagcugugcagcccccugcccaccgccggcggccagaucaacgugaucgagaucaaccacgaccugacccugagcaccaagaccuacgugugcaccaccgacugcaccaucggcaucgacaaggagaacgcccagaucaccuuccagaccaacaagcugaacuacuucgaggugagcggcaccaccaucagcagcggcugguucaagagcaagaccagcgugagccuggaccagaccugcgagcaccugaaggugagcugcggcaagaagagcaugcaguuccacgccugcuucaagcagcacaugagcugcaucagauaccugcacaagaccgcccugcccggcuacauggccgccagcaucugcagcaacaucgagcugaucaucaugaccacccugacccuggccaucuucauccugcugugcaucaucaccaagaccuacaucugcuaccugcugaugccccuguucaugcccaucgccuacaucuacggcuggcuguacaacaagagcugcaagaagugcaacugcugcggccugagcuaccaccccuucaccaacugcggcagcuacugcgugugcggcgccaaguucgagaccagcgacagaaugagaauccacagagagagcggccugugccagggcuacaagagccugagaguggccagaaagcugugcaagagcaagggcagcagccuggugaucagcgugacccugagcguguucaucuucagcuucaucacccccaucggcggcgugaucaucaacgacaagcugagcgaggagaaguacagcaucaaccagaugauggacgccaucguggaccuggagaacuucagccacaacgugagcggcacccagcaggugaucagcgugaucuuccugcugaucagcugccuguuccugcugcugaccuacagacugaacaagaucauccagcaccuggccagaagcggccugcuguucugcgaggagugcagcauguaccacagcaagaaggacaucaaguacaacggcgacuucaccaacaagugcggcuucugcaccugcggccagcccgaggaccccgagggccugaaccugcacauccugagccagaacugcaccuacaagcagcaguucaagugggugaagaucaucaucagcauccugcugagccugaucaucaucgagagcagcaugauccuggccgccgccgagaccgacugcuucagcgagaagcagaucagcgaguucugccugggcccccugcugagcaucagcagcugcgaggacaagaacagcagaaccuucaagggcgaggcccagaagcugguggcccugaagaagaucaccagcgacgaggccaugcugaucgagagcaugggcgccaagguggaggacgcccugaagaugauccaggcccagaagagccccgacagcauguacaccauggaguacguguuccugaacaccuacugcgacuacuacagccuguucgagcacaacagcggcuacagccagaucaaguggagauacauccugaagacccaccaguucgacgccugcgccagacacagcaacaaccacuucugcagaugcaugagcgacggcaugcacugccccagccuggacugggacaucgccgacgagcugaacaacaccuacaucaccaagcccaacuucuucaagcacgacuacaaccugcugcuggacgugaucaccgccgccuuccccggcaccggcgccguguucgugaucgacgccugcaagaaggccaacgccaccgccaucaagaccuucagcaacaacaucaucgccagauuccccuacaacaaccugcugaagggcgugaugaaguuccugcaguacaucagcaagcaccccagcuucaagaaguaccagcccgacaccagacacuacgaccugauccccguggcccccaccgccagaggcagaagccugggcagaagcaacagcuacagcgacgcccaggugggcccccccaccaaggacugccagaagcugaaggaggugggcugccugagccccaaguucggccugccccuggagagcaucaucagcugcggcagcagccccaacuacaagcuguacaagaagccccagaaguacuacaagagcaacaacaaggagaacaccuggugcagcaaggacgugcacugccugcacgacuucgagcccaucaccgaggacgugcuggagaaggugaaggugaugaccugcugggagaucgagcccggcaccaucgaggacaucuucaccaucgccagcgagaccugcaagaucaacgacagaggcgugugcgaggugaacgccgccaaguggaagaucgugaagugcgagaccggccuguacuacuacaccgaccacagagagggcgacgacaccggcagcgaccugggccacuacugccugacccacaagugcgccggcggcagauaccccaucaaccccgagauccugcagaacugcaucugggaguuccacagccagaagagccaguacaucaaccagguggaccuggagcagaucgaggaguacaagaaggcccugaccgagaagcugacccacacccugaaccacuacaacuuccugcccaccaagaaccugccccacaucagccccaacuacaaguacgugacccugaacggccaggagaccagcgacggcaucgagaacagcuacaucgugagcgagauccccgccaucgccggcaccagcaucggccugaaggugcagaccaagaacaacggcaacaucuucgaccugaucaucuacgugaagagagccgacaucaucgccagcuacaaccacaucuacgacaccggccccaccaucggccacaacguggagcacgaggagcugugcaccggccagugcccccagcacauccccgccaaggccaacuggcugaccuucagccaggagagaaccagcagauggggcugcgaggaguucggcugccuggccaucaacaccggcugcguguacggcagcugccaggacaucaucaagcccguggccaagguguacagaaagagcaccgaggagaagguggagcuggagcugugcaucgugcugcccgacagaaacuucugcaccacccugaacgcccuggagcccaagaucaccgaggagaucgagcugcaguucaagaccaucgaccaggugagccugcccaacaucgugcugcugagagaccacaagcuguucaagggccagaucaacgaccugggcaccuucggccagaacugcggcaacgugcagaagaccaaccagagcauccugggcgccggcaccgugagauucgacuaccugugccacagcgccagcagaaaggacaucaucaucagaagaugcuacaacaacaacuacgacagcugcaaccaccugcagcuggccgagagccugaucuuccuggacaaccacgagacccuggaggugagaaagcccaaccacauccugggcacccugagcaugaagcugaugcugggcgacuuccaguacaagaccuucgccaaggacaucgagcuggacuucaccggcagaugcgugggcugcaucggcugcuucgagggcuucgugugcgagaugcacaucaccaccaccguggaggccaccugcaaccuggaggccagcugccaguucuuccacaaccagcugcacaucaagcccgacgugcugaaguacuacaccaagaugaccugccagaccgacgaguacauccccagcaagaucaagaucugcaacaaggaguacaagaucaccaucggcaaggugagaaagaacgacaagaucgagaucgacaacagcgaccagaccagcuacaucaaggagaaggacgagagaugcaagaccuggcugugcagagugagagacgagggcaucagcgugaucuucgagccccugcugaacaucuucggcaacuacggcagaaucgccguggccgugaucagcgccauccuggcccugaucgugcugguguacauccugaugcccaucugcaugaagaucagagacauccugaagaccaacgagaaggaguuccugaucgagagcaaguacaaguga

SEQ ID NO: 9285 - RNA, 4311 nt, Artificial Sequence
  derived and/or modified CDS sequence (opt4) from TENV(TSV-FE3-66FB)__FJ943508.1__GP
auggagaucuucuucaucgcccugcuggccaucgccaacagcgugaacagcaccccccuggccaccagaugcuuccacggcggccagcugaucgccgagagcaagagcgccaccagccugagcgaguucugccugaaggacgacgugagcaugaucaagagcgagaucuacuacgugaagaacgagaccggcaucuucagccacaacaaggugcugagaagcuggaccaucaaggacuggaaguucugcaaccccgugcccaccgccggcggcagcaucaacgugaucgaggugaacagcgacaugagccuggccaccaagaccuacgugugcagcagagacugcaccaucaccaucgacagagaggaggcccagaucaucuuccagaccgagaagcugaaccacuucgaggugagcggcaccacccugagcagcggcugguucaagagcaaggccagcgugacccuggacagaaccugcgagcaccugaaggugaccugcggcaagaagagccugcaguuccacgccugcuucaagcaccacaugagcugcaucagauucuuccacaacaccaugcugcccggcagaaucgugaacagcaugugccagaacaucgagcugaucaucauccugggccugaccaucgugaucuucauccugauggugauccugaccaagaccuacaucugcuacauccugaugccccuguucaugcccaucgccuacaucuacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcauccugcugagcaugcugcugcugagcuucgugacccccaucgagggcgcccugaccaacuacccccagagcaagcuguacagccuggaggagaucgccgacgugguggagggccugaucaccgagcacaacgugaaggaguacaucguguucuacaccagccuguucggcggccugauccugcugcuggccuucauccugagcaucaugcugaccaaggugaccagcaugcuggccagaaccaacgugaucuacugcgaggagugcagcauguaccacagcaagaccggcaucaaguacaacggcgacuucaccaacaagugcggcuucugcaccugcgacgagcaggaggacgccgagggcaucaucauccacaaggugagcaagaagugcaccuacaaguaccagcugaagugggccagaaucaucaugaucauccugaucgugcugcugaccacccagaacaccauccugaucguggccgccgagguggacugcugggagagagccacccugagccaggagugcaucggcccccugcagaagaucgaggacugccagaacaaggaggagaagaccuacaugagcgaggccaacaagcuggugagccagagcaagaucacccaggccgacgccgaccaggugagcgugcugggcgacaccaucgacagcgccaucaaggccaucagaagccagaagaccuaccagaccaugcaccugcuggagaccguguuccugaugaagaacugcgacuacuacagcaccuucgagcacaacagcggcuacagccaggccaaguggagacugauggccaagaccaaccacuucgacaucugcagcagacacagcaaccaccacuucugcagaugcgugaccgagggcaccaagugccagaacggcgacugggacuucgccggcgagaugaacagcaccuacaacaccaagagcgacuucuaccagcacgaccugaaccuguucuucagccuguacgagagcgccuuccccggcaccgccgagagccuguucuaccagcugaucagcgagaagaacaccaccggcgccagccagcugcugggccagaucaucaagaaguucgccaacaacaacaugcugaucggcguguggaaguucggccaguaccugcugacccugcccuacgugaacaccaccaagcugagcaagagcagagaggagaccauccugaccaaccaccagagacuggugagaagcuacaccggcagacagcagagcauggccaacgccgaggugggcgagagcaccaagaacugccugaacgccaagaacgugggcugcaucagccccagauucggcgugcccaucggcaaccugaccgugugcggcgagagcaccaacuacaagguguacaagacccccgccaagaucuacaagagcaacaacagacccaagaccuggugcagcgaggacgugcacugccugagcaacuucgagcccgccagcgccgagguggugaacaagaucaagagaaugaccugcuuccugaccgacgugaccaccaacguggacguguucagcaucgccaucagcaccugcaagauggccgacaagggcgugugcaccgugaacgacgccagauggagcauccugaagugcgacagcggccugcuguacuucaccgaccacagagagggccaggacaccggcaacgacuucggcgaguacugcaucagccacaacugcaacaccgagagauaccccaucaaccccgacaucaucaaggacugcaucugggaguaccacagcagaaagagcaaguacaucagcgccaucaaccuggagagccuggaggaguucagaagagccaugagcgagaagcugagccacacccuggugaucuacaacuucaagcccaccgccaaccugccccacaucaagcccagcuacaagagcaucaccgugaacggcaucgagaacagcgacggcaucgagagcgccuacauccugagcaacauccccgccaucggcggcaugagcgugggcuacaacgugcugaccaaggacggcuucccccugcuggacaucaucaucuucaucaagagcgccgugaucaagaccaccuacaaccacaucuacgacaccggccccaccaucggcaucaacacccugcacgacgagaagugcaccggccccugccccagcaucaucccccacaaggagaacuggcugaccuucagccaggagagaaccagcagauggggcugcgaggaguucggcugccuggccaucaacaccggcugcguguucggcagcugccaggacaucaucagacccgagaccaagaucuacagaaaggccguggaggaggaggugauccugaacgccugcaucaacuuccccggcaacaccuacugcaccgagaucaacgccaucgagcccaagaucaccgacgagaucgagcugcaguucaagaccguggacaccaagacccugcccaaccugcuggccgugcagaaccacaagcuguacagcggccagaucaacgacaucggcaccuucagccagggcugcggcaacgugcagaagaccaaccagaccaugcugggcaccggcaccgugagauucgacuacgugugccacggcgccagcagaaaggacaucaucgugagaagaugcuacaacaacaacuacgagagcugcaagcugcugaaggaggagaagagccugaucuucgccgacaaccacgagacccuggagguggccaacaccagacaccugcugggcgagcugcaguucaagaucaugcugggcgacaucagauacaaggccuucgccgagaagcccgagcuggagaucgacgccaagugcgugggcugccccagcugcuucgagagcuacagcugcaacuuccagaucgugagcaacguggacaccgugugcuacaucgagggccccugcacccuguuccacaacagaaucaucaucaagaccaugaagcaggccuacggcaucaagaugagcugcaagaccaagcccgcccccagcgaggaguucaagaucugcggcagaaccuacaacguggccuucaacaccguggagaagaacgacaagaucgagaucaacaccggcgaccagaccagcuacaucagcgagaaggacgacagaugcaagaccuggcugugcagagugagagacgagggcaucagcgugaucuucgagccccugaagaaccuguucggcaacuacuucaacaucgccuucuacaucaucaucggccugaucgcccuguuccugaccaucuacaucuuccugcccauguucuucaagcugagagacgugcugaagagaaacgaguaccuguaccugcaggagcugaagcacaaguga

SEQ ID NO: 9286 - RNA, 4311 nt, Artificial Sequence
  derived and/or modified CDS sequence (opt4) from TENV(TSV-FL06)__FJ943506.1__GP
auggagaucuucuucaucgcccugcuggccaucgccagcagcgugaacagcaccccccuggccaccagaugcuuccacggcggccagcugaucgccgagagcaagagcgccaccagccugagcgaguucugccugaaggacgacgugagcaugaucaagagcgagaucuacuacgugaagaacgagaccggcaucuucagcuacaacaaggugcugagaagcuggaccaucaaggacuggaaguucugcaaccccgugcccaccgccggcggcagcaucaacgugaucgaggugaacagcgacaugagccuggccaccaagaccuacgugugcagcagagacugcaccaucaccaucgacagagaggaggcccagaucaucuuccagaccgagaagcugaaccacuucgaggugagcggcaccacccugagcagcggcugguucaagagcaaggccagcgugacccuggacagaaccugcgagcaccugaaggugaccugcggcaagaagagccugcaguuccacgccugcuucaagcaccacaugagcugcaucagauucuuccacaacaccaugcugcccggcagaaucgugaacagcaugugccagaacaucgagcugaucaucauccugggccugaccaucgugaucuucauccugauggugauccugaccaagaccuacaucugcuacauccugaugccccuguucaugcccguggccuacaucuacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcauccugcugagcaugcugcugcugagcuucgugacccccaucgagggcgcccugaccaacuacccccagagcaagcuguacagccuggaggagaucgccgacgugguggagggccugaucaccgagcacaacgugaaggaguacaucguguucuacaccagccuguucggcggccugauccugcugcuggccuucauccugagcaucaugcugaccaaggugaccagcaugcuggccagaaccaacgugaucuacugcgaggagugcagcauguaccacagcaagaccggcaucaaguacaacggcgacuucaccaacaagugcggcuucugcaccugcgacgagcaggaggacgccgagggcaucaucauccacaaggugagcaagaagugcaccuacaaguaccagcugaagugggccagaaucaucaugaucauccugaucgugcugcugaccacccagaacaccauccugaucguggccgccgagguggacugcugggagagagccacccugagccacgagugcaucggcccccugcagaagaucgaggacugccagaacaaggaggagaagaccuacaugagcgaggccaacaagcuggugagccagagcaagaucacccaggccgacgccgaccaggugagcgugcugggcgacaccaucgacagcgccaucaaggccaucagaagccagaagaccuaccagaccaugcaccugcuggagaccguguuccugaugaagaacugcgacuacuacagcaccuucgagcacaacagcggcuacagccaggccaaguggagacugauggccaagaccaaccacuucgacaucugcagcagacacagcaaccaccacuucugcagaugcgugaccgagggcaccaagugccagaacggcgacugggacuucgccggcgagaugaacagcaccuacaacaccaagagcgacuucuaccagcacgaccugaaccuguucuucagccuguacgagagcgccuuccccggcaccgccgagagccuguucuaccagcugaucagcgagaagaacaccaccggcgccagccagcugcugggccagaucaucaagaaguucgccaacaacaacaugcugaucggcguguggaaguucggccaguaccugcugacccugcccuacgugaacaccaccaagcugagcaagagcagagaggagaccacccugaccaaccaccagagacuggugagaagcuacaccggcagacagcagagcauggccaacgccgaggugggcgagagcaccaagaacugccugaacgccaagaacgugggcugcaucagccccagauucggcgugcccaucggcaaccugaccgugugcggcgagagcaccaacuacaagguguacaagacccccgccaagaucuacaagagcaacaacagacccaagaccuggugcagcgaggacgugcacugccugagcaacuucgagcccgccagcgccgagguggugaacaagaucaagagaaugaccugcuuccugaccgacgugaccaccaacguggacguguucagcaucgccaucagcaccugcaagauggccgacaagggcgugugcaccgugaacgacgccagauggagcauccugaagugcgacagcggccugcuguacuucaccgaccacagagagggccaggacaccggcaacgacuucggcgaguacugcaucagccacaacugcaacaccgagagauaccccaucaaccccgacaucaucaaggacugcaucugggaguacuacagcagaaagagcaaguacaucagcgccaucaaccuggagagccuggaggaguucagaagagccaugagcgagaagcugagccacacccuggugaucuacaacuucaagcccaccgccaaccugccccacaucaagcccagcuacaagagcaucaccgugaacggcaucgagaacagcgacggcaucgagagcgccuacauccugagcaacauccccgccaucggcggcaugagcgugggcuacaacgugcugaccaaggacggcuucccccugcuggacaucaucaucuucaucaagagcgccgugaucaagaccaccuacaaccacaucuacgacaccggccccaccaucggcaucaacacccugcacgacgagaagugcaccggccccugccccagcaucaucccccacaaggagaacuggcugaccuucagccaggagagaaccagcagauggggcugcgaggaguucggcugccuggccaucaacaccggcugcguguucggcagcugccaggacaucaucagacccgagaccaagaucuacagaaaggccguggaggaggaggugauccugaacgccugcaucaacuuccccggcaacaccuacugcaccgagaucaacgccuucgagcccaagaucaccgacgagaucgagcugcaguucaagaccguggacaccaagacccugcccaaccugcuggccgugcagaaccacaagcuguacagcggccagaucaacgacaucggcaccuucagccagggcugcggcaacgugcagaagaccaaccagaccaugcugggcaccggcaccgugagauucgacuacgugugccacggcgccagcagaaaggacaucaucgugagaagaugcuacaacaacaacuacgagagcugcaagcugcugaaggaggagaagagccugaucuucgccgacaaccacgagacccuggagguggccaacaccagacaccugcugggcgagcugcaguucagaaucaugcugggcgacaucagauacaaggccuucgccgagaagcccgagcuggagaucgacgccaagugcgugggcugccccagcugcuucgagagcuacagcugcaacuuccagaucgugagcaacguggacaccgugugcuacaucgagggccccugcacccuguuccacaacagagugaucaucaagaccaugaagcaggccuacggcaucaagaugagcugcaagaccaagcccgcccccagcgaggaguucaagaucugcggcagaaccuacaacguggccuucaacaccguggagaagaacgacaagaucgagaucaacaccggcgaccagaccagcuacaucagcgagaaggacgacagaugcaagaccuggcugugcagagugagagacgagggcaucagcgugaucuucgagccccugaagaaccuguucggcaacuacuucaacaucgccuucuacaucaucaucggccugaucgcccuguuccugaccaucuacaucuuccugcccauguucuucaagcugagagacgugcugaagagaaacgaguaccuguaccugcaggagcugaagcacaaguga

SEQ ID NO: 9287 - RNA, 4305 nt, Artificial Sequence
  derived and/or modified CDS sequence (opt4) from TLAV(61D240)__KX100119.1__GP
augcuguuccugcugauccuggccuuccugggcuucagcaccagcaaccccaucgccaccagaugcuuccacggcggccagcugaucgccgagagcaagagcgccaccagcaucagcgaguucugccugaaggacgacgugagcaugcugaagagcgaggugguguacaccaagaacgacaccggccuguucggccacaacaagguguucagaagcuggaccaucaaggacuggaagcugugcaaccccauccccaccgccggcggcaccaucaacgugaucgaggugaacaaggaccugagccugaugaccaagaccuacaucugcagcagagacugcaccaucaccaucgacaaggaggaggcccagaucaucuuccagaccgacaagcugaaccacuucgaggugagcggcaccacccugaacagcggcugguucaagagcaaggccagcgugacccuggacagaaccugcgagcacgugaaggugaccugcggcaagaagagccugcaguuccacgccugcuucaagcaccacaugagcugcgugagauucuuccacaacaccauccugcccggcaacaugaucaccagcaugugccagaacaucgagcugaucaucauccugggccugacccuggccaucuucauccugauggugaugcugaccaagaccuacaucugcuaccugcugaugcccaucuucaugcccaucgccuaccuguacggcugggccuacaacaagagcugcaagaagugcaacugcugcggccuggccuaccaccccuucaccaacugcggcagccacugcgugugcggccugaaguucgaggccagcgacagaaugagaauccacagagagagcggccugugccagggcuacaagagccugagaaucgccagacugcugugcaagagcaagggcagcagccuggugaucagcggccugcugagcaugcugauccugagcuucgugacccccaucgagggcaccaucaccagcuaccccgagagcagaaaguacacccuggaggagaucaccgacgugguggagggccuggugagcgagcagaacaucaaggaguacaucguguucuacaccagccuguucggcagccugauccugcugcuggccuucaucaugagcaucacccugagcaagaucaccagcauccuggccagaagaaacgugaucuacugcgaggagugcagcauguaccacagcaagagaggcaucaaguacaacggcgacuucaccaacaagugcggcuucugcaccugcaacgagcaggaggacgccgagggccuggugauccacaaggugagcaagagaugcaccuacaaguaccagcugaagugggccaaggugcugauggugacccuggugcugcugcugaucgcccagaacaccauccugaucguggccgccggcaccgacugcuggaccaagaagagccuggacaucgacugcaucggccccaugcuggacaucggcagcugcaccaacaagaacaccagaaacuacgacaccgaggcccagaagcuggugagccagagcaaggugagccagcuggacgccgaccaggccagccugcugggcaacagcaucgacagcgccaucaaggccaucagagcccagaagaccuaccccaccaugcaccugcuggagaccaucuuccugaugaagaacugcgacuacuacaccagcuucaaccacaacagcggcuacagccaggccaaguggagacugaucgccaagaccggccacuucgacaucugcagcagacacagcacccaccacuucugcagaugcaucaacgacggcaccaagugccagaacggcgacugggacuucgccggcgagaugaacgagaccuacaacagcaagaacgacuucuacagccacgaccugaaccuguucuacaccaucuucgagaacgccuuccccggcaccaccgagagccuguucuaccagcugauccagaagaagaacaccaccggcgccagcaagauccugggcaagcugaucaccaaguacggcaacaagaacauguucgugggcguguggaaguucggccaguaccugcugacccugcccuacaucaacaacaccgagcugagccagaacagaagacagaccauccuggccacccaggagagccugagcagaagccacagcggcagacaggagagcaugagcagcgccauccagggcagcgugaccaaggagugccacaacgccaaggacgugggcugcaucagccccagauucggcauccccaucggcaaccugaccgccugcggcgacagccccaacuacaagaucuacaagacccccgagaagcuguacaagagcaacaacaagggcgagguguggugcagcaacgacgugcacugccugaacgacuucgagcccgccgacgaggagguggugaacaaggugaagaagcugaccugcuuccugaccgacgugagcgugaagaccgacaucuucagcguggccgccagcaccugcaagauggccgacaagggcgugugcaccgugaacgacgccaaguggaacaucaucaagugcgacagcggccuguacuacuucaccgaccacagagagggccaggacaccggcaacgacuucggcgaguacugcaucagccacagcugcaacaccgagagauuccccaucaaccccgacauccugaaggacugcaccugggaguuccacagcagaaagagcaaguacaucagcaccaucagccuggagagccuggaggaguucagaagagccaugaccgagaagcugagccacacccugaccaucuacaacuucaagcccaccgccaaccugccccacaucagacccaccuacaaguucaucaccgccaacggcguggagaacagcgacggcaucgagagcgccuacauccugagcagcauccccgcccugggcggcaucagcgugggcuacaacgugcagaccaaggacaacuucccccugcuggacaucaucguguucaucaagagcgccgugaucagaaccaccuacaaccacaucuacgacaccggccccaccaucggcaucaacacccagcacgacgagcacugcaccggccccugccccgccguggugccccacaaggagaacuggaucaccuucagccaggagagaaccagcagauggggcugcgaggaguucggcugccuggccaucaacaccggcugcguguucggcagcugccaggacaucauccaccccgagaccaagguguacagaaaggccguggaggaggaggugauccugaccgugugcaucaacuuccccggcaacaacuacugcaccgagaucaacgccaucgagcccaagaucaccgacgagaucgagcugcaguucaagaccguggacaccaagacccugcccaaccugcuggccgugcagaaccacaagcuguacagcggccagaucaacgaccugggcagcuucagccagggcugcggcaacgugcagaagaccaaccacagcauccugggcaugggcaccgccaaguucgacuacgugugccacggcgccagcagaaaggacgugaucgugagaagaugcuacaacaacaacuucgacagcugcaagcugcugaaggaggagaccagccugaucuucgccgacaaccacgagacccuggagguggcccacaccaagcaccugaucggcgagcugcaguucaagaucaugcugggcgacaucagauacaagagcuucgccgagagccccgagcuggagaucgacgccaagugcgugggcugccccagcugcuucgagagcuacagcugcaacuuccagaucgugaccaacaucgacaccgugugcagcguggagggccccugcacccuguuccacaacagaaucaucaucagcgccaacaagcagagcuacggccugaagaugagcugccagaccaagcccaaccagaacgaggaguucaucaucugcaacagaaaguacagcgugcuguucaccaccaucgacaagaacgacaagaucgaggugaacaccggcgaccagaccagcuacaucuacgagaaggacagcagaugcaagaccuggcugugcagagugagagacgagggcaucagcgugcuguucgagccccugaaggccuucuucggcagcuacuucagcaucaucuucuacgugguggugggcaucaucgugcuguuccugaucaucuacaucuuccugcccauguucuucaagcugaaggacgugcugaagagaaacgaguaccuguaccugcaggagcugaagcacaaguga

SEQ ID NO: 9288 - RNA, 4305 nt, Artificial Sequence
  derived and/or modified CDS sequence (opt4) from NRIV(9800535)__AY593725.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagaagaacaacaccggccuguucgcccacagcaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugaugaucauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccuggugaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccugcugcugcugaucgcccuggugaucaccaucacccugaacaaggugaccgaguaccugaccaacaucaacgugcuguacugcuacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaccauccuggugugccugcugaucgcccagaacaccauccugaucguggccgccagcgacgacugcuggaccaagaagagccuggagauggagugcaucggcccccugcagcagguggacaccugcgacgacaaggccagcagaagcuacagcggcgaggccagaaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccugggcaagcacugcgacuacuacaagaccuucgagcacaacagcggcuacagccaggccaaguggagacugaccgccaagacccaccacuucgacaucugcagcagacacagcacccaccacuucugcagaugcaucagcgacggcaccaagugccagaacggcgaccuggacuucgccggcgagaugaacagcaccuaccagagcaagaaggacuucuucgagcacgacuucaagcuguucugcacccugguggagaacgccuuccccggcaccaccgagagccuguucuacgagaugcugagcaagaagaacaccaccggcaucaagcagcugcuggacaagcugaccagaaaguucggcaacaacaacauguucgugggcaucuggaaguucggccaguaccugaugagccugcccuacaucaacgagaccagccugacccccgcccagaucagcaagauccuggaggugaccgaccagcaccacagaagcaucagcggcagacaggagagccuggccagcgccacccccggcagcaagagcaaggagugcggccacgccaagaaggugagcugcaucagccccagauucagcgugcccauggagggccugauggccugcggcgacagccccaacuacaagaucuacaagacccccaccaagcuguacaagagcaacaacaagggcgagguguggugcagcggcgacgugcacugcagccaggagcugagccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagacggccaggacaccggcaacgacuucggcgaguacugccugagccacagcugcagaaucgagagauuccccaucaaccccgccaucaucagagacugccugugggaguaccacagcagaaagagcaaguacaucaccagccuggaccuggagaaccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucgccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagagaaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgccagcaacaucgacaccgugugcagcaucgagggccccugcaccaccuuccacaacagacugaugaucaccagcaccaagcaggacuacggcaucaagaugagcugcaagaccaagcccaaggagaccgaggaguuccagaucugcaagaagaccuacaccgugcuguucaccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacguggugaucagcaucaucgugcuguuccuggccaucuacaucuuccugcccaugguguucaagcugagagacgugcugaagagaaacgaguaccuguaccugcaggagaucaagcacaaguga

SEQ ID NO: 9289 - RNA, 4305 nt, Artificial Sequence
  derived and/or modified CDS sequence (opt4) from NRIV(GSA/TS7/5170/WT)__KM514677.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagagaaacaacaccggccuguucgcccacagcaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccuggugaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccugcugcugcugauggcccuggugaucaccaucacccugaacaaggugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacagauaccagcugaccuggagcaagaucaucaugaccauccuggugugccugcugaucgcccagaacaccauccugaucguggccgccagcgacgacugcuggaccaagaagagccuggagauggagugcaucggcccccugcagcagguggacaccugcgacgacaaggccagcagaagcuacagcggcgaggccaagaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccugggcaagcacugcgacuacuacaagaccuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccagcgagaugaacagcaccuaccagagcaagaaggacuucuucgagcacgacuucaagcuguucugcacccugguggagaacgccuuccccggcaccaccgagagccuguucuacgagaugcugagcaagaagaacaccaccggcaucaagaaccugcuggacaagcugaccagaaaguucggcaacaacaacauguucgugggcaucuggaaguucggccaguaccugaucagccugcccuacgugaacgagaccagccugacccccgcccaggugagcaagauccuggaggugaccgaccagcaccacagaagcaucagcggcagacaggagagccuggccagcgccaccagcggcagcaagagcaaggagugcggccacgccaagaaggugagcugcaucagccccagauucagcgugcccauggagggccugauggccugcggcgacagccccaacuacaagaucuacaagacccccgccaagcuguacaagagcaacaacaagggcgagguguggugcagcggcgacgugcacugcagccaggagcugagccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagacggccaggacaccggcaacgacuucggcgaguacugccugagccacagcugcagaaucgagagauuccccaucaaccccaccaucaucagcgacugccugugggaguaccacagcagaaagagcaaguacaucaccagccuggaccuggagaaccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucagcgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgccagcaacaucgacaccgugugcagcaucgagggccccugcaccaccuuccacaacagacugaugaucaccagcaccaagcaggacuacggcaucaagaugagcugcaagaccaagcccaaggagaccgaggaguuccagaucugcaagaagaccuacaccgugcuguucaccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacgugguggugaucaucaucgugcuguuccuggccaucuacaucuuccugcccaugguguucaagcugagagacgugcugaagagaaacgaguaccuguaccugcaggagaucaagcacaaguga

SEQ ID NO: 9290 - RNA, 4305 nt, Artificial Sequence
  derived and/or modified CDS sequence (opt4) from NRIV(TND/S1/19801/WT)__KM514679.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagagaaacaacaccggccuguucgcccacagcaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccuggugaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccugcugcugcugauggcccuggugaucaccaucacccugaacaaggugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacagauaccagcugaccuggagcaagaucaucaugaccauccuggugugccugcugaucgcccagaacaccauccugaucguggccgccagcgacgacugcuggaccaagaagagccuggagauggagugcaucggcccccugcagcagguggacaccugcgacgacaaggccagcagaagcuacagcggcgaggccaagaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccugggcaagcacugcgacuacuacaagaccuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccagcgagaugaacagcaccuaccagagcaagaaggacuucuucgagcacgacuucaagcuguucugcacccugguggagaacgccuuccccggcaccaccgagagccuguucuacgagaugcugagcaagaagaacaccaccggcaucaagaaccugcuggacaagcugaccagaaaguucggcaacaacaacauguucgugggcaucuggaaguucggccaguaccugaucagccugcccuacgugaacgagaccagccugacccccgcccaggugagcaagauccuggaggugaccgaccagcaccacagaagcaucagcggcagacaggagagccuggccagcgccaccagcggcagcaagagcaaggagugcggccacgccaagaaggugagcugcaucagccccagauucagcgugcccauggagggccugauggccugcggcgacagccccaacuacaagaucuacaagacccccgccaagcuguacaagagcaacaacaagggcgagguguggugcagcggcgacgugcacugcagccaggagcugagccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagacggccaggacaccgccaacgacuucggcgaguacugccugagccacagcugcagaaucgagagauuccccaucaaccccaccaucaucagcgacugccugugggaguaccacagcagaaagagcaaguacaucaccagccuggaccuggagaaccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucagcgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgccagcaacaucgacaccgugugcagcaucgagggccccugcaccaccuuccacaacagacugaugaucaccagcaccaagcaggacuacggcaucaagaugagcugcaagaccaagcccaaggagaccgaggaguuccagaucugcaagaagaccuacaccgugcuguucaccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacgugguggugaucaucaucgugcuguuccuggccaucuacaucuuccugcccaugguguucaagcugagagacgugcugaagagaaacgaguaccuguaccugcaggagaucaagcacaaguga

SEQ ID NO: 9291 - RNA, 4305 nt, Artificial Sequence
  derived and/or modified CDS sequence (opt4) from NRIV(9800521)__JX857326.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagaagaacaacaccggccuguucgcccacagcaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugaugaucauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccuggugaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccugcugcugcugauggcccuggugaucaccaucacccugaacaaggugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaccauccuggugugccugcugaucgcccagaacaccauccugaucguggccgccagcgacgacugcuggaccaagaagagccuggagauggagugcaucggcccccugcagcagguggacaccugcgacgacaaggccagcagaagcuacagcggcgaggccagaaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccugggcaagcacugcgacuacuacaagaccuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgacuucaagcuguucugcacccugguggagaacgccuuccccggcaccaccgagagccuguucuacgagaugcugagcaagaagaacaccaccggcaucaagcagcugcuggacaagcugaccagaaaguucggcaacaacaacauguucgugggcaucuggaaguucggccaguaccugaugagccugcccuacgugaacgaggccagccugacccccgcccagaucagcaagauccuggaggugaccgaccagcaccacagaagcaucagcggcagacaggagagccuggccagcgccacccccggcagcaagagcaaggagugcggccacgccaagaaggugagcugcaucagccccagauucagcgugcccauggagggccugauggccugcggcgacagccccaacuacaagaucuacaagacccccaccaagcuguacaagagcaacaacaagggcgagguguggugcagcggcgacgugcacugcagccaggagcugagccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagacggccaggacaccggcaacgacuucggcgaguacugccugagccacagcugcagaaucgagagauuccccaucaaccccgccaucaucagagacugccugugggaguaccacagcagaaagagcaaguacaucaccagccuggaccuggagaaccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucgccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagagaaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgccaccaacaucgacaccgugugcagcaucgagggccccugcaccaccuuccacaacagacugaugaucaccagcaccaagcaggacuacggcaucaagaugagcugcaagaccaagcccaaggagaccgaggaguuccagaucugcaagaagaccuacaccgugcuguucaccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacguggugaucagcaucaucgugcuguuccuggccaucuacaucuuccugcccaugguguucaagcugagagacgugcugaagagaaacgaguaccuguaccugcaggagaucaagcacaaguga

SEQ ID NO: 9292 - RNA, 4305 nt, Artificial Sequence
  derived and/or modified CDS sequence (opt4) from NRIV(Adrar)__KJ716849.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagaagaacaacaccggccuguucgcccacagcaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccuggugaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccugcugcugcugauggcccuggugaucaccaucacccugaacaaggugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaccauccuggugugccugcugaucgcccagaacaccauccugaucguggccgccagcgacgacugcuggaccaagaagagccuggagauggagugcaucggcccccugcagcagguggacaccugcgacgacaaggccagcagaagcuacagcggcgaggccaagaagcuggugagagccagcaagaucagcgaccuggacgccgcccaggugggccugcugggcagcaccaucgagagcgccaucgccagcaucagaaagcagagaaccuaccccaccaugcaccugcuggagagcguguuccugggcaagcacugcgacuacuacaagaccuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgacuucaagcuguucugcacccugguggagaacgccuuccccggcaccaccgagagccuguucuacgagaugcugagcaagaagaacaccaccggcaucaagaagcugcuggacaagcugaccagaaaguucggcaacaacaacauguucgugggcaucuggaaguucggccaguaccugaucagccugcccuacgugaacgagaccagccugacccccgcccaggugagcaagauccuggaggugaccgaccagcaccacagaagcaucagcggcagacaggagagccuggccagcgccacccccggcagcaagagcaaggagugcggccacgccaagaaggugagcugcaucagccccagauucagcgugcccauggagggccugauggccugcggcgacagccccaacuacaagaucuacaagacccccgccaagcuguacaagagcaacaacaagggcgagguguggugcagcggcgacgugcacugcagccaggagcugagccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagagggccaggacaccggcaacgacuucggcgaguacugccugagccacagcugcagaaucgagagauuccccaucaaccccgccaucaucagcgacugccugugggaguaccacagcagaaagagcaaguacaucaccagccuggaccuggagaaccuggaggaguucaagagagccaucagcgagaagcugagccacacccugaucguguacaacuucaagcccaccgccaaccugccccacaucaagcccaucuacaaguacaucaccgugcagggcguggagaacagcgacggcguggacagcgccuacaucgccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagaagcgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaaccugagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgccagcaacaucgacaccgugugcagcaucgagggccccugcaccaccuuccacaacagacugaugaucaccagcaccaagcaggacuacggcaucaagaugagcugcaagaccaagcccaaggagaccgaggaguuccagaucugcaagaagaccuacaccgugcuguucaccaccguggagaagaacgacaagaucgagaucagcaccggcgaccagaccagcuucauccaggagaaggacgacagaugcaagaccuggcugugcagagugagagacgagggcaucagcgugaucuucgagcccaucagagccuucuucggcagcuacuucagcaucgccuucuacguggugaucagcaucaucgugcuguuccuggccaucuacaucuuccugcccaugguguucaagcugagagacgugcugaagagaaacgaguaccuguaccugcaggagaucaagcacaaguga

SEQ ID NO: 9293 - RNA, 4305 nt, Artificial Sequence
  derived and/or modified CDS sequence (opt4) from NRIV(DakArD28542)__JX857317.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagaagaacaacaccggccuguucgcccacagcaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccuguuccugcugauggcccuggugaucaccaucacccugaacaaggugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaccauccuggugugccugcugaucgcccagaacaccauccugaucguggccgccagcgacgacugcuggaccaagaagagccuggagauggagugcaucggcccccugcagcagguggacaccugcgacgacaaggccagcagaagcuacagcggcgaggccaagaagcuggugagagccagcaagaucagcgaccuggacgccgcccaggugggccugcugggccccaccaucgagagcgccaucgccagcaucagaaagcagagaaccuacagcaccaugcaccugcuggagagcguguuccugggcaagcacugcgacuacuacaagaccuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgaccugaagcuguucugcacccugguggagaacgccuuccccggcaccaccgagagccuguucuacgagaugcugagcaagaagaacaccaccggcgugaagaagcugcuggacaagcugaccagaaaguucggcaacaacaacauguucgugggcaucuggaaguucggccaguaccugaugagccugcccuacgugaacgagaccagccugacccccgcccagguggccaagauccuggaggugaccgaccagcaccacagaagcaucagcggcagacaggagagccuggccagcgccacccccggcagcaagagcaaggagugcagccacgccaagaaggugagcugcaucagccccagauucagcgugcccauggagggccugauggccugcggcgacagccccaacuacaagaucuacaagacccccgccaagcuguacaagagcaacaacaagggcgagguguggugcagcggcgacgugcacugcagccaggagcugagccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagacggccaggacaccggcaacgacuucggcgaguacugccugagccacagcugcagaaucgagagauuccccaucaaccccgccaucaucagcgacugccugugggaguaccacagcagaaagagcaaguacaucaccagccuggaccuggagaaccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucgccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgccagcaacaucgacaccgugugcagcaucgagggccccugcaccaccuuccacaacagacugaugaucaccagcaccaagcaggacuacggcaucaagaugagcugcaagaccaagcccaaggagaccgaggaguuccagaucugcaagaagaccuacaccgugcuguucaccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacgugguggugagcaucaucgugcuguuccuggccaucuacaucuuccugcccaugguguucaagcugagagacgugcugaagagaaacgaguaccuguaccugcaggagaucaagcacaaguga

SEQ ID NO: 9294 - RNA, 4305 nt, Artificial Sequence
  derived and/or modified CDS sequence (opt4) from NRIV(SUD-HKV141)__JX857323.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagaagaacaacaccggccuguucgcccacagcaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcugagcaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccuguuccugcugauggcccuggugaucaccaucacccugaacaaggugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaccauccuggugugccugcugaucgcccagaacaccauccugaucguggccgccagcgacgacugcuggaccaagaagagccuggagauggagugcaucggcccccugcagcagguggacaccugcgacgacaaggccagcagaagcuacagcggcgaggccaagaagcuggugagagccagcaagaucagcgaccuggacgccgcccaggugggccugcugggccccaccaucgagagcgccaucgccagcaucagaaagcagagaaccuacagcaccaugcaccugcuggagagcguguuccugggcaagcacugcgacuacuacaagaccuucgagcacaacagcggcuacagccaggccaaguggagacugaccgccaagacccaccacuucgacaucugcagcagacacagcacccaccacuucugcagaugcaucagcgacggcaccaagugccagaacggcgacugggacuucgccggcgagaugaacagcaccuaccagagcaagaaggacuucuucgagcacgaccugaagcuguucugcacccugguggagaacgccuuccccggcaccaccgagagccuguucuacgagaugcugagcaagaagaacaccaccggcgugaagaagcugcuggacaagcugaccagaaaguucggcaacaacaacauguucgugggcaucuggaaguucggccaguaccugaugagccugcccuacgugaacgagaccagccugacccccgcccagguggccaagauccuggaggugaccgaccagcaccacagaagcaucagcggcagacaggagagccuggccagcgccacccccggcagcaagagcaaggagugcggccacgccaagaaggugagcugcaucagccccagauucagcgugcccauggagggccugauggccugcggcgacagccccaacuacaagaucuacaagacccccgccaagcuguacaagagcaacaacaagggcgagguguggugcagcggcgacgugcacugcagccaggagcugacccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagacggccaggacaccggcaacgacuucggcgaguacugccugagccacagcugcagaaucgagagauuccccaucaaccccgccaucaucagcgacugccugugggaguaccacagcagaaagagcaaguacaucaccagccuggaccuggagaaccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucgccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgugagcaacaucgacaccgugugcagcaucgagggccccugcaccaccuuccacaacagacugaugaucaccagcaccaagcaggacuacggcaucaagaugagcugcaagaccaagcccaaggagaccgaggaguuccagaucugcaagaagaccuacaccgugcuguucaccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacgugguggugagcaucaucgugcuguuccuggccaucuacaucuuccugcccaugguguucaagcugagagacgugcugaagagaaacgaguaccuguaccugcaggagaucaagcacaaguga

SEQ ID NO: 9295 - RNA, 4305 nt, Artificial Sequence
  derived and/or modified CDS sequence (opt4) from NRIV(SUD-HKV66)__JX857320.1__GP
augcugcugcugcuggugcugcugauccccugcuacgugagcgccagccccguggugaccagaugcuuccacggcggccagcugaucgccgagaagaagagccagaccgccgugagcgaguucugccugaaggacgacgugagcaccaucaagagcgagaucaccuacgagaagaacaacaccggccuguucgcccacagcaaggugcugagaaacuggaucaucaaggacuggaagaacugcaaccccgugcccaccgccggcggcagcaucaacgugaucgaggugaacaccgaccugagccugaccaccaagaccuacgugugcagcagagacugcaccaucaccguggacaaggaggacgcccagaucaucuuccagaccgagaagcugaaccacuucgaggugagcggcaccacccugagcagcggcugguucaagaccaaggccagcgugacccuggacagaaccugcgagcacaucaaggugaccugcggcaagaagacccugcaguuccacgccugcuucaagcaccacaugagcugcaucagauucuuccacggcaccauccugcccggcaccauggccaccagcaucugccagaacaucgagcugaucaucaucaucagccugacccugaucaucuucauccugauggugauccugaccaagaccuacaucugcuaccugcugaugccccuguucaugcccaucgccuacuucuacggcuggagcuacaacaagagcugcaagaagugcagcugcugcggccuggccuaccaccccuucaccaacugcggcagccacugcgugugcggccugaaguucgaggccagcgacagaaugagaauccacagagagagcggccugugccagggcuacaagagccugagaguggccagacugcugugcaagagcaagggcagcagccugaucaucagcauccugcuggccaugcugauccugagcuucgugacccccaucgagggcacccugaccaacuaccccgagagcagaaaguacgaccuggaggagaucgccgacgugcuggagggcuucaucguggagaagggcaucaaggaguacgugguguucuacaccagcaucuucggcgcccuguuccugcugauggcccuggugaucaccaucacccugaacaaggugaccgaguaccugaccaacaucaacgugcuguacugccacgagugcagcauguaccacagcaagaagaacaucaaguacaucggcgacuucaccaacaagugcggcuucugcaccugcggcgagcuggaggaccaggagggccugaagauccacaaggugagcagaaagugcaucuacaaguaccagcugaccuggagcaagaucaucaugaccauccuggugugccugcugaucgcccagaacaccauccugaucguggccgccagcgacgacugcuggaccaagaagagccuggagauggagugcaucggcccccugcagcagguggacaccugcgacgacaaggccagcagaagcuacagcggcgaggccaagaagcuggugagagccagcaagaucagcgaccuggacgccgcccaggugagacugcugggccccaccaucgagagcgccaucgccagcaucagaaagcagagaaccuacagcaccaugcaccugcuggagagcguguuccugggcaagcacugcgacuacuacaagaccuucgagcacaacagcggcuacagccaggccaaguggagacugaccgccaagacccaccacuucgacaucugcagcagacacagcacccaccacuucugcagaugcaucagcgacgccaccaagugccagaacggcgacugggacuucgccggcgagaugaacagcaccuaccagagcaagaaggacuucuucgagcacgaccugaagcuguucugcacccugguggagaacgccuuccccggcaccaccgagagccuguucuacgagaugcugagcaagaagaacaccaccggcgugaagaagcugcuggacaagcugaccagaaaguucggcaacaacaacauguucgugggcaucuggaaguucggccaguaccugaugagccugcccuacgugaacgagaccagccugacccccgcccagguggccaagauccuggaggugaccgaccagcaccacagaagcaucagcggcagacaggagagccuggccagcgccacccccggcagcaagagcaaggagugcggccacgccaagaaggugagcugcaucagccccagauucagcgugcccauggagggccugauggccugcggcgacagccccaacuacaagaucuacaagacccccgccaagcuguacaagagcaacaacaagggcgagguguggugcagcggcgacgugcacugcagccaggagcugacccccgccagccaggagagcguggacagaaucaagcagaucaccugcuuccugaccgagcccgaggugagcgacgacguguucagcaucgccaucagcaccugcaaggugcaggacaagggcgugugcaccgugaacgaggacagauggaacgugaucaagugcgacagcggccugaucuacuacaccgaccagagagacggccaggacaccggcaacgacuucggcgaguacugccugagccacagcugcagaaucgagagauuccccaucaaccccgccaucaucagcgacugccugugggaguaccacagcagaaagagcaaguacaucaccagccuggaccuggagaaccuggaggaguucaagagagccaucagcgagaagcugagccacacccugaucguguacaacuucaagcccaccgccaaccugccccacaucaagcccguguacaaguacaucaccgugcagggcguggagaacagcgacggcguggacagcgccuacaucgccgccagcaugcccgcccugagcggcaccagcaucggcuacaacaucaugagcagagacaacuucccccuguucgacaucaucaucuucaucaagagcgccaucaucaaggccaccuacaaccacaucuacgacaccggccccaccaucggcaucaacgugaugcacgacgagcacugcaccggccagugccccaccgacaucccccacaaggagaacuggaucaccuucgcccaggagagaaccagcagauggggcugcgaggaguucggcugccuggccgugaacaccggcugcguguucggcagcugccaggacaucaucagacccgagaccaagguguacagaaaggccguggaggagagcgugcugcugaccgugugcaucaccuaccccggcaagaccuucugcaccgagaucaacgccaucgagcccaagaucaccgacgagcuggagcugcaguucaagaccguggacaccaagacccugcccaacauccuggccgugcagaaccacaagcuguacagcggccagaucaacgaccugggcagcuucagccagggcugcggcaacauccagaagaccaacagcagcaucaucggcaccggcaccgccaaguucgacuacgugugccacggcgccagcagaaaggacaucaucgugagaagaugcuacaacaacaacuacgagagcugcaagcugcugaaggaggagcagagccugauguucgccgacaaccacgagaccaucgacguggccaacgugagacaccugcugggcgaccugcaguucaagcugaugcugggcgaccugagauacaagagcuucgccgagaaccccgaccuggagaucgaggccaagugcgugggcugccccagcugcuucaccagcuacagcugcagcuucaagaucgccagcaacaucgacaccgugugcagcaucgagggccccugcaccaccuuccacaacagacugaugaucaccagcaccaagcaggacuacggcaucaagaugagcugcaagaccaagcccaaggagaccgaggaguuccagaucugcaagaagaccuacaccgugcuguucaccaccguggagaagaacgacaagaucgagaucagcaccggcgaccagaccagcuucauccaggagagagacgacagaugcaagaccuggcugugcagagugagagacgagggcaucagcgugaucuucgagcccaucagagccuucuucggcagcuacuucagcaucgccuucuacgugguggugagcaucaucgugcuguuccuggccaucuacaucuuccugcccaugguguucaagcugagagacgugcugaagagaaacgaguaccuguaccugcaggagaucaagcacaaguga

SEQ ID NO: 9296 - RNA, 4344 nt, Artificial Sequence
  derived and/or modified CDS sequence (opt4) from BWAV(M459)__NC_034490.1__GP
auggccauguucgagcugaucgugcugcuggccuucagcuacgugaccggcgugccccaggagcugaccagaugcuucaccggcggcagcguggugagacagcacuggagcaagaacgccaucagcgagcugugccugaaggacgacgugagcaucaucaagagcgagaucgaguacaagaagaacgagaccggcaccuucgcccugagcaagaucuacagaaaguggaucaccaccgacugggagaagugccagccccagaagagcaccggcggccacaucagcgugcuggaggugagacacgaccugacccuggccagcgccaccuacaucugcggcaaccccugcaccaucaacguggacagagagauggcccaggugcaccugcagaccgagggcgugaaccacuucgagaucagcggcaccaccaucaagagcggcugguucaagaccaccaccuacaucacccuggaccagaccugcgagcaccugaaggugagcugcggcaagcagagcgugcaguuccacgccugcuucaagcagcacauggccugcgugagauuccugcacagaaccauccugcccggcaacauggccaacagcaucugccagaacaucgagaucaucauccugcuggcccugacccugagcaucuucauccugcugugcauccugaccaagaccuacaucugcuacauccugcugcccaucuucauccccaucagcuacaucuacggcuacuucuacaacagaagcugcaagaagugcagccagugcggccugguguaccaccccuucaccgagugcggcagaaacugcgugugcggcgccagauacgacaccagcgagagaaugaagcugcacagacugagcggccugugccccggcuacaagagccugaaggccgccagagugcugugcaagagcaagggcagcgccagcauccugagcauccugaucagccugcugauccugaccuucgugacccccaucaacggccugaugcugaaggacaccgacaucaccaaccugaagaucgacacccugcccgacgacaugcuggagcugauccacaacguggacuaccugaagcugauccuggagaucaacaucaccaucuucggcuucauccugaucaucauccuguucaugcugcugauguucuacagauaccagcacaucuucaucagcaucuacgugaucgacugcaaggagugcaacauguaccacagcaagagcggccugagauacaacggcgacuucaccaacaagugcaugaccugcaccugcggcgagguggacgacauggagggccugaacaagcacaagaagagauacaacugccugaucaaguacaagaccaccauccugcagcacuucuuccugagcauccuggugugccugauccugaaggagagcgugcuguucgccgccgcccagagcgaggagaucaucaagugccuggagcaggagagccugaccagcaagugcaccggcccccugcugaagaccccccagugcaccgagcagcagaagaaccugcuguucaucgagaucgccaagcagauggagaaggacaacaucaucaccagccuggacaacgcccugaucgccaagcugcccaacgagaucgccggcagcauggccauccuggacaccaagaaguacuaccacgagcagaucacccuggaguacgccauccugagcaaguacugcgacuacuacaagaaguacgagggcaacaccggcuacagccagaccaccuggagaaccuaccugagaagccaggaccuggagaucugccugauccugcccuaccaguucuucugcagaugcuucaagagcggcaccggcugcaucgacaccaagauggagaucaagagcaccauggacaccuacuacagcagccaccagaccaaguucgacagcgaccugaacuacaugcugcacgugauccaccuggccuucagaggcagcgccaccagcuacaucgccaagugccugaucgagaagaacuacaccgagaccaucagcuaccugaccaagauccaggagaaguaccccaacaaccagcugcugaagguggccaucuucuucaccaaccaccugcugaaccagagccugguggagaacuucgaggugagcaccgaguggagcagauacaagcacagcaccgcccagcccgagcacgaguggaagaagggcagcgagcugaagaugcuggaccccaacaagcugaagaccggccccgccauccagaccugccugcacaucaaggaccugcacugcaucagccccagaagcagagcccccaccagcggcaucaucaccugcggccugaacgaccaggccugcguguacagaaagcccgacaagaagaucuacgccagccacaugacccagcacggcuucugcgugauggacggccacugccugaagcccuucgagcccaucagcggcgagaugcugcagaucaucaagaagagcaagugcuggaccgaggacaucgaggaccugaucaccgagggccaggacaagggcagaaucagcugccagcccaucgacgugggcaacugcaacgugagcggcaaccuguggaccaucacccugugcagcgacaagaaguucuacuacaccgacaacaagcacgugcacgacaacagcaaggacaucggcuacuacugcauggaggagaacugcaagauccccagauuccccauccaccccgacuucgugaaggacugcgagugggaccugaaccacaucaagaucgaccaccugaagcagaucaacaucgaggacaucaacagcuacaagaagauccugaccgagaagcugaccaccgcccugaacagcuucaaguacaagggcaacgagaaccugccccacagcauccccaaguacaaguacaucaccauccagggcacccagaccaucgacggcaucgagaacgccuucaucgagguggagauccccgcccugagcggcagcgccaccggcuucaagaucagcagcagagacggcaucgagcuguucgacgccauccuguacgugaagcaggccagcuucagcagcguguacaagaagcuguacgugaccggccccaccaucggcaucaacaccaagcacgacgagagaugcaccggcgccugccccaugacccugccccacagcuacggcuggcugaccuucagcaaggagagaaccagccaguggggcugcgaggaguacggcugccuggccaucagcgacggcugcguguucggcagcugccaggacaucaucaaggacgaccugaccaucuacagaaaggagaccgaggagcugagccuggccgagaucugcaucaccuucaugcacaacaccuucugcaccagcaucgacagcaccacccccaccaucaccgacauccuggaggcccaguucaagaccguggagagcuucaagcugcccaacaccgugggccugaagaugcacaagcuguacaucggcaccaucaacgacaucggcguguacaagaaggccugcggcaacgugcagaaguacaacaacaccauccugggcagcggcagccccaaguucgacuacgugugccaccuggccaagagaaaggacgugauccugagaaagugcuucgacaacgacuacaacagcugcaagcugcugaagguggccaacgaccugagaaucgaggaggacggcgagaagcugaaggugaucaacuacaagaaggugaugggcacccugaaguucaaggccaucuucggcgacaucaaguacaagagcuucacccaggacguggacaucgacgccgaggccaccugcgugggcugccugaacugcuucgagaacaucaacugcgagaucaaggugcagagcccccuggagaccaccugcgagguggagagcagcugcgaccuguucaccaccagaauccuguuccaccaggacauccacaaguacgcccugaagcugaucugcagcaaggaggccagcagcaaguucuggaucagauucugcaacaaggagaucaagagcagcaucagccugaucaacgccgcccccauccuggagcuggcccccaucgaccagaccagcuacgugaaggaggaggacgagagaugcggcaccuggaugugcagaguggcccaggagggcaucggcgugaucuucgagcccuucaagaaccuguucggcagcuaccugggcaucuucuacaucaucaucaucgugaucauccugcuggugcuguucguguacaucuuccugcccaugauccugaagcugaaggagauccugcagaagaacgagguggccuaccagagagacaugaagaucagauga

SEQ ID NO: 9297 - RNA, 4344 nt, Artificial Sequence
  derived and/or modified CDS sequence (opt4) from BWAV(UgAr1888)__KJ867186.1__GP
auggccaucuucaagcugaucgugcugcuggccuucagcuacgccaccggcgugccccaggagcugagcagaugcuucaccggcggcagcguggugagacagcacuggagcaagaacgccaucagcgagcugugccugaaggacgacgugagcaucaucaagagcgagaucgaguacaagaagaacgagaccggcaccuucgcccugaacaagaucuacagaaaguggaucaccaccgacugggagaagugccagccccagaagagcaccggcggccacaucagcgugcuggaggugagacacgaccugacccuggccagcgccaccuacaucugcggcaaccccugcaccaucaacguggacagagagauggcccaggugcaccugcagaccgagggcgugaaccacuucgagaucagcggcaccaccaucaagagcggcugguucaagaccaccaccuacaucacccuggaccagaccugcgagcaccugaaggugagcugcggcaagcagagcgugcaguuccacgccugcuucaagcagcacauggccugcgugagauuccugcacagaaccauccugcccggcaacauggccaacagcaucugccagaacaucgagaucaucauccugcuggcccugacccugagcaucuucauccugcugugcauccugaccaagaccuacaucugcuacauccugcugcccaucuucauccccaucagcuacaucuacggcuacuucuacaacagaagcugcaagaagugcagccagugcggccugguguaccaccccuucaccgagugcggcagaaacugcgugugcggcgccagauacgacaccagcgagagaaugaagcugcacagacugagcggccugugccccggcuacaagagccugaagaccgccagagugcugugcaagagcaagggcagcgccagcauccugagcauccugaucagccugcugauccugaccuucgugacccccaucaacggccugaugcugaaggacaccgacaucaccaaccugaagaucgacacccugcccgacgacaugcuggagcugauccacaacguggacuaccugaagcugauccuggagaucaacaucaugaucuucggcuucauccugaucaucauccuguucaugcugcugauguucuacagauaccagcacaucuucaucagcaucuacgugaucgacugcaaggagugcgacauguaccacagcaagagcggccugagauacaacggcgacuucaccaacaagugcaugaccugcaccugcggcgagguggacgacauggagggccugaacaagcacaagaagagauacaacugccugaucaaguacaagaccaccauccugcagcacuucagccugagcaugcuggugugccugauccugaaggagagcgugcuguucgccgccgcccagcccgaggagaucaucaagugccuggagcaggagagccugaccagcgagugcaccggcccccugcugaagaccccccagugcaccgagcagcagaagaaccugcuguucauggagaucgccaagcagauggagaaggacaacgugaucaccagccuggacaacgcccugaucgccaagcugcccaacgagaucgccggcagcauggccauccuggacaccaagaaguacuaccacgagcagaucacccuggaguacgccauccugagcaaguacugcgacuacuacaagaaguacgagggcaacaccggcuacagccagaccaccuggagaaccuaccugagaagccaggaccuggagaucugccugauccugcccuaccaguucuucugcagaugcuucaagagcggcaccggcugcaucgacaccaagaucgaguucaagagcaccauggacaccuacuacagcagccaccagaccaaguucgacagcgaccugaacuacaugcugcacgugauccaccuggccuucagaggcagcgccaccagcuacaucgccaagugccugaucgagaagaacuacaccgagaccaucagcuaccugaccaagauccaggagaaguaccccaacaaccagcugcugaagguggccaucuucuucaccaaccaccugcugaaccagagccugguggagaacuucgaggugagcaccgaguggagcagauacaagcacagcgccacccagcccgagcacgaguggaagaagggcagcgagcugaagauccuggacagcaacaagcugaagaccggccccgccauccagaccugccugcacaucaaggaccugcacugcaucagccccagaagcagagcccccaccagcggcaucaucaccugcggccugaacgaccaggccugcguguacagaaagcccaacaaggagaucuacgccagccacaugacccagcacggcuucugcaucauggacggccacugccugaagcccuucgagcccaucagcggcgagaugcugcagaucaucaagaagagcaagugcuggaccgaggacaucgaggaccugaucaccgagggccaggacaagggcagaaucagcugccagcccaucgacgugggcaacugcaacgugagcggcaaccuguggaccaucacccugugcagcgacaagaaguucuacuacaccgacaacaagcacgugcacgacagcagcaaggacgugggcuacuacugcauggaggagaacugcaagauccccagauuccccauccaccccgacuucgugaaggacugcgagugggaccugaaccacauggagaucgaccaccugaagcagaucaacaucgaggacaucaacagcuacaagaagauccugaccgagaagcugaucaccgcccugaacagcuucaaguacaagggcaacgagaaccugccccacagcauccccaaguacgaguacaucaccauccagggcacccagaccaucgacggcaucgagaacgccuucaucgagguggagauccccgcccugagcggcagcgccaccggcuucaagaucagcagcagagacggcaucgagcuguucgacgccauccuguacgugaagcaggccagcuucagcagcguguacaagaagcuguacgugaccggccccaccaucggcaucaacaccaagcacgacgagagaugcaccggcgccugccccgugacccugccccacagcuacggcuggcugaccuucagcaaggagagaaccagccaguggggcugcgaggaguacggcugccuggccaucagcgacggcugcguguucggcagcugccaggacaucaucaaggacgaccugaccguguacagaaaggagaccgaggagcugagccuggccgagaucugcaucaccuucaugcacaacaccuucugcaccagcaucgacagcaccacccccaccaucaccgacauccuggaggcccaguucaagaccguggagagcuucaagcugcccaacaccgugggccugaagaugcacaagcuguacaucggcaccaucaacgacaucggcguguacaagaaggccugcggcaacgugcagaaguacaacaacaccauccugggcagcggcagccccaaguucgacuacgugugccaccuggccaagagaaaggacgugauccugagaaagugcuucgacaacgacuacaacagcugcaagcugcugaagguggccaacgaccugagaaucgaggaggacggcgagaagcugaaggugaucaacuacaagaaggugaugggcacccugaaguucaaggccaucuucggcgacgugaaguacaagagcuucacccaggacguggacaucgacgccgaggccaccugcgugggcugccugaacugcuucgagaacaucaacugcgagaucaaggugcagagcccccuggagaccaccugcgagguggagagcagcugcgaccuguucaccaccagaauccuguuccaccaggacauccacaaguacgcccugaagcugaucugcagcaaggaggccaccagcaaguucuggaucagauucugcaagaaggagaucaagagcagcaucagccugaucaacgccgcccccauccuggagcuggcccccaucgaccagaccagcuacgugaaggaggaggacgagagaugcggcaccuggaugugcagaguggcccaggagggcaucggcgugaucuucgagcccuucaagaaccuguucggcagcuaccugggcaucuucuacaucaucaucaucgugaucauccugcuggugcuguucguguacaucuuccugcccaugauccugaagcugaaggagauccugcagaagaacgagguggccuaccagagagacaugaaggugagauga

SEQ ID NO: 9298 - RNA, 4332 nt, Artificial Sequence
  derived and/or modified CDS sequence (opt4) from BWAV/PGAV(SAAr1)__KJ867177.1__GP
augaucugcaucugcaucuucguggccaucuuccccgccaucuacgccauccccgacagcuacagcagaugcuucaccggcggcaccguggugaaggagauguggagcaaggacgccgugaccgagcugugcaucaaggacgacgugagcaucgugaagaccgagaccagcuacaagaagaacggcaccggcaccuucgcccugaacaaggugaccagaaaguggcugaugaccgacugggagaagugcaagccccagaagagcagcagcggccacaucaacgugaucgaggugagagacgaccugacccuggccaccagcaccuacaucugcagcagcagcugcaccaucaacguggacagagagaccgcccagauccagcugaacaccgacagcaucaaccacuucgagaucgccggcaccaccaucaagaccggcugguucaagagcaccacccugguggcccuggaccagaccugcgagcaccugaaggugagcugcggcaagcagagcgugcaguuccacgccugcuucaaccagcacaugagcugcgugagauuccugcacagaaccauccugcccggcaacauggccaagagcaucugccagaacaucgagaucaucauccuggugggccugaucauccugaucuuccugcugcugugcauccugaccaagaccuacaucugcuacauccugcugcccaucuucaucccccugagcuacgccuacggcuacuucuacaacaaggccugcaagaagugcagccagugcggccugguguaccaccccuucaccgagugcggcagcaacugcgugugcggcgccagauacgacaccagcgagagaaugaagcugcacagaaucagcggccugugccccggcuacaagagccugagaaccgccagagugcugugcaagagcaagggcagcgccagcauccugagcauccugaucagcauccugauccugauguucgugacccccaucaacggcuacaugaucaccaacgaguucgacgagggcaagcugaccguggacagccugcccgacgacaugcugagcaugaucagcagacugagcgcccugcaguucaucuucacccugaacaucgccugcagcgugcuggugacccugcugaccugccuguuccugaucaucuucuacagauuccagcacagauuccugagcaaguacgccaucaacugcaccgagugcgacauguaccaccagaagaagggccugaucuacaacggcgacuucaccaacaagugcaugaccugcaccugcggcgaggugaacgacauggagggccugaacaagcacaagaagagauacaacugccugaucaaguacaaggccgccugguuccugaaccugaccaucaccaucaucugccugaugcugaucaaggacggcagcaugauggccgccgccgagaccaacaucgagaccugcauggccaagcccagccugaccaccgacugcaccggccccuuccugaagaucaccaagugcgacgagagccagaaggcccugcccuuccaggagaucgccaagcagcuggugaagagcaacgugcugacccugcuggacaagcacaucguggagaagcugcccaacgagaucgccggcagccugagcauccuggacaagaagcagcacuaccacgagcagcuggccguggaguacggcauccugagcaaguacugcgacuacuacgagcuguacaagagcaacagcggcuacagccagagcaccuggggcaccuaccugagaagccacgacuucgagaucugccugcugcugcccuaccaguacgugugcagaugcuucaagagcggcaccggcugcaccgacaccaaguucgaguucgagcagaagaugaacgagaccuacaacagcaagaacgacauguacaacagcgacuucacccuggcccugaccgugcugcaccuggccaugagaggcaccgccagcaccuacaucaucgacaacgugcugcagaagaacuacagcaacgugaucgaguaccugaacaccaccaagaacaacuucaagagcaaccagguguucggcgugcugguggacuucaccaucuaccugcugagacacgccagcuacgccaaguacaaccugccccagagccugaagaaguucagaagcgugagcagcgaccugaccaccaucagcggcagaagcagcggccagaacaucgugagcgaccugcaccagggcgacgugaucaagaccugccugaacaucaagcagcugaacugcaucagccccaagagcagaaccaccaccaccaaccugaucaccugcggcagcagccagaucagcguguacaaccugcccagaggccagcuguacgagagcgugaccaccgagcacggcaccugcgccggcgacggccacugccugaccgacuucaugcccaucaacagcgacuuccuggccacccugaagaagagcaagugcuggaccaccgacauccccaacaucaucaagcugguggagagcgacggcaagaucagcugccagcccaucgacgugggcagcugcaacgugagcggcaacaucuggaccaucaccaagugcagcgacaacaaguacuacuacaccgacaacaagcacgugcacgacgacgagaaggacaucggccacuacugcauggaggagaccugcaaguucgugagauuccccaucaacgacaaguucgugagcaacugcgagugggaccugaaccacaucgagaucaacaagcugaaccagguggagcuggacaacaucaacgccuacaagaaggugcugaccgagaagcugaccagcagccugagcguguucaaguacaagcugacccagaaccugccccacgugauccccaaguucaaguacaucaccauccagggcacccagaccguggacggcaucgagaacagcuucaucgagguggagauccccgcccugagcggcgccgccagcggcuucaagaucaugaccaaggagaacaacgagcuguucgacgccauccuguacgugaagcaggccagcuucagcagcaucuacaagaagaucuacaccaccggccccaccaucggcaucaacaccaagcacgacgagaagugcaccggcgccugccccgugaaccugccccacagcaccggcuggcugaccuucgccaaggagagaaccagcaccuggggcugcgaggaguacggcugccuggccaucaacgacggcugcguguucggcagcugccaggacaucaucaaggacgagauguacaucuucaagaaggagaccgaggagguggcccugguggagaucugcaucagcuucaaccacaagaccuucugcaccgacguggacagcaccacccccaucaucaccgacacccuggaggcccaguucaagaccguggagagcuacaagcugcccaaccacguggcccugaagcagcacaagcuguacgugggccagaucaacgacuucggcguguacaagaaggccugcggcaacgugcagaagaucaacaacaccaucuacggcgagggcacccccagauucgacuaccugugccaccuggccaagagaaaggacgugcuggugagaaagugcuucgacaacgacuacaacagcugcagccugcugaccaucgccgacgaccugagacuggaggaggacggcgagaagcugaaggugaucaacuacagaaaggugcugggcagcaugaaguucaaggcccuguucggcgacaucagauacaagagcuucaccgaggacaucgagcuggacguggaggccagcugcgccggcugcaucaacugcuucgacaacauccacugcgagaucaagcugaccaacggccuggacaccagcugcagcuucgagagcagcugcgacgccuucaacagcagaauccuguucaacagcaaccagcacguguacagcaccaagcugaucugcaccaaggagcagaccaaggccuucgagaucaagaucugcggcaagaccaucaaggccgaccugguggugaccgaggccaagcccauccuggagcugacccccaucgaccagaccagcuacaucaaggaggaggacaccagaugcggcaccugguucugcagacugaccaaggagggcuucagcgugcugcuggagcccuucaagaaccuguucggcagcuaccugggcaucgccuacaccaucaucaucgcccugcugugccuguucguguucaucuacaucauccugcccaugaucaugaagcugaaggaggugcugaagcagaacgagaucgccuaccagaaggagcagaagaagagauga

SEQ ID NO: 9299 - RNA, 4332 nt, Artificial Sequence
  derived and/or modified CDS sequence (opt4) from BWAV/PGAV(191B-07)__KJ867180.1__GP
augaucuacaucuacaucuucguggccaucuuccccgccaucuacgccauccccgacagcuacagcagaugcuucaccggcggcaccguggugaaggagauguggagcaaggacgccgugaccgagcugugcaucaaggacgacgugagcaucgugaagaccgagaccagcuacaagaagaacggcaccggcaccuucgcccugaacaaggugaccagaaaguggcugaugaccgacugggagaagugcaagccccagaagagcagcagcggccacaucaacgugaucgaggugagagacgaccugacccuggccaccagcaccuacaucugcagcagcagcugcaccaucaacguggacagagagaccgcccagauccagcugaacaccgacagcaucaaccacuucgagaucgccggcaccaccaucaagaccggcugguucaagagcaccacccugguggcccuggaccagaccugcgagcaccugaaggugagcugcggcaagcagagcgugcaguuccacgccugcuucaaccagcacaugagcugcgugagauuccugcacagaaccauccugcccggcaacauggccaagagcaucugccagaacaucgagaucaucauccuggugggccugaccauccugaucuuccugcugcugugcauccugaccaagaccuacaucugcuacauccugcugcccaucuucaucccccugagcuacgccuacggcuacuucuacaacaaggccugcaagaagugcagccagugcggccugguguaccaccccuucaccgagugcggcagcaacugcgugugcggcgccagauacgacaccagcgagagaaugaagcugcacagaaucagcggccugugccccggcuacaagagccugagaaccgccagagugcugugcaagagcaagggcagcgccagcauccugagcauccugaucagcauccugauccugauguucgugacccccaucaacggcuacaugaucaccaacgaguucgacgagggcaagcugaccguggacagccugcccgacgacaugcugagcaugaucagcagacugagcgcccugcaguucaucuucacccugaacaucgccugcagcgugcuggugacccugcugaccugccuguuccugaucaucuucuacagauuccagcacagauuccugagcaaguacgccaucaacugcaccgagugcgacauguaccaccagaagaagggccugaucuacaacggcgacuucaccaacaagugcaugaccugcaccugcggcgagguggacgacauggagggccugaacaagcacaagaagagauacaacugccugaucaaguacaaggccgccugguuccugaaccugaccaucaccaucaucugccugaugcugaucaaggacggcagcaugauggccgccgccgagagcaacaucgagaccugcauggccaagcccagccugaccaccgacugcaccggccccuuccugaagaucaccaagugcgacgagagccagaaggcccugcccuuccaggagaucgccaagcagcuggugaagagcaacgugcugacccugcuggacaagcacaucguggagaagcugcccaacgagaucgccggcagccugagcauccuggacaagaagcagcacuaccacgagcagcuggccguggaguacggcauccugagcaaguacugcgacuacuacgagcuguacaagagcaacagcggcuacagccagagcaccuggagaaccuaccugagaagccacgacuucgagaucugccugcugcugcccuaccaguacgugugcagaugcuucaagagcggcaccggcugcaccgacaccaaguucgaguucgagcagaagaugaacgagaccuacaacagcaagaacgacauguacaacagcgacuucacccuggcccugaccgugcugcaccuggccaugagaggcaccgccagcaccuacaucaucgacaacgugcugcagaagaacuacagcaacgugaucgaguaccugaacaccaccaagaacaacuucaagagcaaccagguguucggcgugcugguggacuucaccaucuaccugcugagacacgccagcuacgccaaguacaaccugccccagagccugaagaaguucagaagcgugagcagcgaccugaccaccaucagcggcagaagcagcggccagaacaucgugagcgaccugcaccagggcgacgugaucaagaccugccugaacaucaagcagcugaacugcaucagccccagaagcagaaccaccaccaccaaccugaucaccugcggcaccagccagaucagcguguacaaccugcccagaggccagcuguacgagagcgugaccaccgagcacggcaccugcgccgacgacggccacugccugaccgacuucaugcccaucaacagcgacuuccuggccacccugaagaagagcaagugcuggaccaccgacauccccaacaucaucaagcugguggagagcgacggcaagaucagcugccagcccaucgacgugggcagcugcaacgugagcggcaacaucuggaccaucaccaagugcagcgacaacaaguacuacuacaccgacaacaagcacgugcacgacgacgccaaggacaucggccacuacugcauggaggagaccugcaaguucgugagauuccccaucaacgacaaguucgugagcaacugcgagugggaccugaaccacaucgagaucaacaagcugaaccagguggagcuggacaacaucaacgccuacaagaaggugcugaccgagaagcugaccagcagccugagcguguucaaguacaagcugacccagaaccugccccacgugauccccaaguucaaguacaucaccauccagggcacccagaccguggacggcaucgagaacagcuucaucgagguggagauccccgcccugagcggcgccgccagcggcuucaagaucaugaccaaggagaacaacgagcuguucgacgccauccuguacgugaagcaggccagcuucagcagcaucuacaagaagaucuacaccaccggccccaccaucggcaucaacaccaagcacgacgagaagugcaccggcgccugccccgugaaccugccccacaacaccggcuggcugaccuucgccaaggagagaaccagcaccuggggcugcgaggaguacggcugccuggccaucaacgacggcugcguguucggcagcugccaggacaucaucaaggacgagauguacaucuucaagaaggagaccgaggagguggcccugguggagaucugcaucagcuucaaccacaagaccuucugcaccgacguggacagcaccacccccaucaucaccgacacccuggaggcccaguucaagaccguggagagcuacaagcugcccaaccacguggcccugaagcagcacaagcuguacgugggccagaucaacgacuucggcguguacaagaaggccugcggcaacgugcagaagaucaacaacaccaucuacggcgagggcacccccagauucgacuaccugugccaccuggccaagagaaaggacgugcuggugagaaagugcuucgacaacgacuacaacagcugcagccugcugaccaucgccgacgaccugagacuggaggaggacagcgagaagcugaaggugaucaacuacagaaaggugcugggcagcaugaaguucaaggcccuguucggcgacaucagauacaagagcuucaccgaggacaucgagcuggacguggaggccagcugcgccggcugcaucaacugcuucgacaacauccacugcgagaucaagcugaccaacggccuggacaccagcugcagcuucgagagcagcugcgacgccuucaacagcagaauccuguucaacagcaaccagcacguguacagcaccaagcugaucugcaccaaggagcagaccaaggccuucgagaucaagaucugcggcaagaccaucaaggccgaccugguggugaccgaggccaagcccauccuggagcugacccccaucgaccagaccagcuacaucaaggaggaggacaccagaugcggcaccugguucugcagacugaccaaggagggcuucagcgugcugcuggagcccuucaagaaccuguucggcagcuaccugggcaucgccuacaccgugaucaucgcccugcugugccuguucguguucaucuacaucauccugcccaugaucaugaagcugaaggaggugcugaagcagaacgagaucgccuaccagaaggagcagaagaagagauga

SEQ ID NO: 9300 - RNA, 4326 nt, Artificial Sequence
  derived and/or modified CDS sequence (opt4) from CEV(283)__KX817313.1__GP
augaucuucaugcugauccuguucgccguggccgccgccagccccguguaccagagaugcuuccaggacggcgccaucgugaagcagaaccccagcaaggaggccgugaccgaggugugccugaaggacgacgugagcaugaucaagaccgaggccagauacaccaagaacagcaccggcguguucagcaacaacguggccaucagaaaguggcuggugagcgacuggcacgacugcagacccagaaagguggugggcggccacaucaacgugaucgaggugggcgacgaccugacccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucagccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacguggagaucaucauccuggugacccuggcccugcugaucuucauccugcugagcaucaucagcaagaccuacaucugcuaccugcugaugcccaucuucauccccaucgccuacaucuacggccugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugauggugggcgagagcaaggagaccuucgagcuggaggagcugcccgacgacaugcuggagauggccaacaaccugaacaccuacuacaugcugugcguggccaacuacgccgugaccuggagccugcugaucguggcccugaucaucggccugcuguucaagaaguaccagcacagauuccuggacaucuacgccauguacugcgaggagugcgacauguaccacgacagaagcggcaucaaguggaacggcgacuucaccaacaagugcggccacugcaccugcggccaguacgaggacgccagcggccugcuggugcacagaaagaccuacaacugccugauccaguacaagagcaaguggaucaugaacuuccuggugaccuacgugauccuggugcugcugaaggacagcguggugaucgugcaggccaagggcguggacuucagcgagugcaucgaggccgagaaggugagauggaacugcaccggccccuucgugaaccugggcaacugcgagaagaagcagaagaaggagcccuacagcaacaucgccgcccagcugaagggccugggcgccaucagcauccuggacgugcccaucaucgccagcauccccgaggacaucgccggcgcccugagauacaucgaggaccagagaagcuaccacagccagcugaccguggaguacgccaugcugaccagauacugcgacuacuacacccaguucagcgacaacagcggcuacagccagaccaccuggagaguguaccugagaagccacgacuucgaggccugcgugcuguaccccaaccagcacuucugcagaugcgugaagcacggcgacaagugcagcagcagcaacugggacuucgccagcgagaugaagaacuacuacagcggcaagcagagcaaguucgacaaggaccugaaccuggcccugaccagccugcaccacgccuucagaggcaccagcagcagcuacaucgccggccugcugagcagcaaggccaacgacgagcuggugcaguacaccagcaagaucagagagaaguuccccggcaacgcccugcugaaggccgugaucgacuacaucgccuacaugaagggccugaccgagaugagcaacuucaagaaggacgaguucugggacgagcugguguacgugcccgaccccaccaagccccccaagcugagcagaagcagcggcaccguguacgacuucaagagcgccaccagcaaccugggcgagaagaacugcaaggacgugaagggcguggugugccugagccccagaagcggcgugaccuacgacagcaucaucgccugcggcgagggcagcagccccaacaucuacagaauccccaagaccggcguguaccagagcaacagcgagcccagcaacuacugcgugagcgacagccacugccuggaggacuucgaggugaucaaccaggaggagcuggacgccaucaagaagagcagaugcugggagguggacuaccuguacgccaaccccagcaagcagagcgacggcaucagaagcugcagaaugagagacgccggccacugcaacgugaccaccaacagauggcccaucauccagugcgacgacaacaaguacuacuacagcgagcugcagagagacuacgacaaggagcaggacaucggccacuucugccugagccccagaugcaccaccgugagauuccccauccaccccaagcacgugagcaacugcgacuggcaggugagccacagcaccguggacaagguggacgugcacaaccuggaggacaucgagcaguacagaaaggccaucacccagaagcugcagaacagccugagcaucuucaaguacgccagaaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaacaccaaggagggcaagcaccugcuggacgugaucgccuacgugaagcaggccagcuacagcagccuguacaacaagauguacgugaccggccccaccgugggcaucaacaccaagcacgacgagcugugcaccggccccugccccgugaacgugccccacagcgacggcuggcugaccuucgccagagagagaaccagcagcuggggcugcgaggaguucggcugccuggccaucagcgacggcugcguguucggcagcugccaggaccugaucaaggaggagcuggccguguacagaaaggagaccgaggaggccaccaacguggagcugugccugaccuucagcgacaagaccuacugcaccgagcugaaccccaucacccccaucaucaccaaccuguucgaggugcaguucaagaccguggagaccuacagccugcccagagugguggccgugcagaaccacgagaucagaaucggccagaucaacgaccugggcaucuacagcaagggcugcggcaacgugcagaaggugaacaacaccaucuacggcaacggcgugcccaaguucgacuaccugugccaccuggccagcagaaaggaggugaucgugagaaagugcuucgacaacgacuuccaggccugcaaguuccugcagagcccccccagcuacagacuggaggaggacgacggcagcaucaccgugaucgacuacaagaagauccugggcaccaucaagaugaaggccauccugggcgacgugaaguacaagaccuucgccgagaacaucgacaucaccgccgagggcgugugcaccggcugcgugaacugcuucgagaacauccacugcgagcugaccauccacaccaccaucgaggccagcugccccgugaccagccccugcacccuguuccacgacagaauccugaucacccccgacgagcacaaguacgccaugaaggugaucugcaccgagaagcagaccggcacccugcccuucaagaucugcaacagcaagguggacgccacccugacccugguggaggccaagcccauccuggagcuggccagcguggaccagaccgccuacaucagagagaaggacgagagaugcaagaccuggaugugcagagugagagacgagggcauccaggugauccuggagcccuucaagaaccuguucggcagcuacaucggcaucuucuacaccagcauccugaucgugaucaccaucuucaucaucaucuacgugauccugcccaucugcuucaagcugaaggacacccugcagaagcacgaggacgccuacaagagagagaugaagaucagauga

SEQ ID NO: 9301 - RNA, 4326 nt, Artificial Sequence
  derived and/or modified CDS sequence (opt4) from CEV(BFS283)__AF123483.1__GP
augaucuucauccugauccuguucgccguggccgccgccagccccguguaccagagaugcuuccaggacggcgccaucgugaagcagaaccccagcaaggaggccgugaccgaggugugccugaaggacgacgugagcaugaucaagaccgaggccagauacaccaagaacagcaccggcguguucagcaacaacguggccaucagaaaguggcuggugagcgacuggcacgacugcagacccagaaagguggugggcggccacaucaacgugaucgaggugggcgacgaccugacccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucagccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacguggagaucaucauccuggugacccuggcccugcugaucuucauccugcugagcaucaucagcaagaccuacaucugcuaccugcugaugcccaucuucauccccaucgccuacaucuacggccugaucuacaacaagagcugcaagaagugcaagcugugcggccugguguaccaccccaucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugauggugggcggcagcaaggagaccuucgagcuggaggagcugcccgacgacaugcuggagauggccaacaaccugaacaccuacuacaugcugugcgugaccaacuacgccgugaccuggagccugcugaucaucgcccuggccaucggccugcuguucaagagauaccagcacagauuccuggacaucuacgccauguacugcgaggagugcgacauguaccacgacagaagcggcaucaaguggaacggcgacuucaccaacaagugcggccagugcaccugcggccaguacgaggacgccagcggccugcuggugcacagaaagaccuacaacugccugauccaguacaagagcaaguggaucaugaacuuccugaucaccuacgugauccuggugcugcugaaggacagcguggugaucgugcaggccaagggcaccgacuucagcgagugcaucgacgccgacaagaucaaguggaacugcaccggccccuucgugaaccugggcaacugcgagaagaagcagaagaaggagcccuacagcaacaucgccgcccagcugaagggccugagcgccaucagcauccuggacgugcccaucaucgccagcauccccgaggacaucgccggcgcccugagauacaucgaggaccagagaagcuaccacagccagcugaccguggaguacgccaugcugaccagauacugcgacuacuacacccaguucagcgacaacagcggcuacagccagaccaccuggagaguguaccugagaagccacguguucgaggccugcauccuguaccccaaccagcacuucugcagaugcgugaagcacggcgacaagugcagcagcagcaacugggacuucgccagcgagaugaagaacuacuacagcggcaagcagaacaaguucaacaaggaccugaaccuggcccugaccagccugcaccacgccuucagaggcaccagcagcagcuacaucgccggccugcugagcaccaaggccaacgacgagcuggugcaguacaccagcaagaucagagagaaguuccccggcaacgcccugcugaaggccaucaucgacuacaucgccuacaugaagggccugaccgagaugagcaacuucaagaaggacgaguucugggacgagcugguguacgugcccgaccccaccaagccccccaagcugagcagaggcagcgagaccguguacgacuucaagagcgccaccagcaaccugggcgagaagaacugcaaggacgugaagggcguggugugccugagccccagaagcggcgugaccuacgacagcaucaucgccugcggcgagggcagcagccccaacaucuacaagauccccaagaccggcguguaccagagcaacagcgagcccagcaacuacugcgugagcgacagccacugccuggaggacuucgaggugaucagccaggaggagcuggacgccaucaagaagagcagaugcugggagguggacuaccuguacgccaacccccccaagcagagcgacggcgugagaagcugcagaaugaaggacgccggccacugcaacgugaccaccaacagauggcccaucauccagugcgacgacaacaaguacuacuacagcgagcugcagagagacuacgacaaggagcaggacaucggccacuucugccugagccccagaugcgccaccgugagauuccccauccaccccaagcacaucagcaacugcgacuggcaggugagccacagcaccguggacaaggugaacgugcacaaccuggaggacaucgagcaguacagaaaggccaucacccagaagcugcagaacagccugagcaucuucaaguacgccagaaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaacaccaaggagggcaagcaccugcuggacgugaucgccuacgugaagcaggccagcuacagcagccuguacaacaagauguacgugaccggccccaccgugggcaucaacaccaagcacgacgagcugugcaccggccccugccccgugaacgugccccacagcgacggcuggcugaccuucgccagagagagaaccagcagcuggggcugcgaggaguucggcugccuggccaucagcgacggcugcguguucggcagcugccaggaccugaucaaggaggagcugaccguguacagaaaggagaccgaggaggccaccaacguggagcugugccugaccuucgccgacaagaccuacugcaccgagcugaaccccgugacccccaucaucaccaaccuguucgaggugcaguucaagaccguggagaccuacagccugcccagagugguggccgugcagaaccacgagaucagaaucggccagaucaacgaccugggcguguacagcaagggcugcggcaacgugcagaaggugaacaacaccaucuacggcaacggcgugcccaaguucgacuaccugugccaccuggccagcagaaaggaggugaucgugagaaagugcuucgacaacgacuuccaggccugcaaguuccugcagagcccccccagcuacagacuggaggaggacgacggcagcaucaccgugaucgacuacaagaagauccugggcaccaucaagaugaaggccauccugggcgacgugaaguacaagaccuucgccgagaacaucgacaucaccgccgagggcgugugcaccggcugcaucaacugcuucgagaacauccacugcgagcugaccauccacaccaccaucgaggccagcugccccgugaccagccccugcacccuguuccacgacagaauccugaucacccccgacgagcacaaguacgccaucaaggugaucugcaccgagaagcagaccggcacccugcccuucaagaucugcaacagcaagaucgacgccacccugacccugguggaggccaagcccauccuggagcuggcccccguggaccagaccgccuacaucagagagaaggacgagagaugcaagaccuggauguacagagugagagacgagggcauccaggugauccuggagcccuucaagaaccuguucggcagcuacaucggcaucuucuacaccagcauccugguggugaucgccauguucaucaucguguacgugauccugcccaucugcuucaagcugaaggacacccugcagagacacgaggacgccuacaagagagagaugaagaucagauga

SEQ ID NO: 9302 - RNA, 4329 nt, Artificial Sequence
  derived and/or modified CDS sequence (opt4) from CHATV(Mohko ILO8-3)__KF719222.1__GP
augaugaucuucauccugauccuguucgccgugagcgccgccagccccguguaccagagaugcuuccaggacggcgccaucgugaagcagaaccccagcaaggaggccgugaccgaggugugccugaaggacgacgugagcaugaucaagaccgaggccagauacgugaagaacgccaccggcaucuacagcaacaacguggccaucagaaaguggcuggugagcgacuggcacgacugcagacccagaaaggugagcggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucgugcugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagaagcagcggccugugccccggcuacaagagccugagagccgccagagugaugugcaagagcaagggccccgccagcauccugagcaucaucaccgccauccuggugcugaccuucgugacccccaucaacagcauggugaucggcgagagcaaggagguguucgagcuggaggagcugcccgacgacaugcuggagauggcccugaagaucaaccuguacuacuucgugugcgugaucaacuacgccgugaccuggagccuggugaucguggcccugcugaucgcccugaucuucaagaaguaccagcacagauuccugaaccuguacgccauguacugcgaggagugcgacauguaccacgacagaaucggccugaagagaaacggcgacuucaccaacaagugcagacagugcaccugcggccaguacgaggacgccaccggccugaugacccacagaaagaccuacaacugccuggugcaguacaagagcaaguggauccugaacuuccugaucaccuacaugauccugacccugaucaaggacagcgccaucaucgugcaggccgccggcaccgacuucagcgccugccuggaggcccagagcguggacuggaacugcaccggccccuuccugaaccugggcaacugccagaagcagcagaagaaggagagcuacgccaacaucgccacccagcugaagggccugcaggccaucagcgugcuggacgugcccaugaucgccaacauccccgaggacaucgccggcgcccugagauacaucgaggagaaggacaccuuccacgugcagcugaccgccgaguacgccaugcugaccagauacugcgacuacuacacccaguucgccgacaacagcggcuacagccagaccaccuggagaguguaccugagaagccacgacuucgacgccugcauccuguaccccaaccagcacuucugcagaugcgugaagcacggcgacaagugcagcagcagcaacugggacuucgccaacgagaugaagaacuacuacagcggcaagcagaacaaguucgacaaggaccugaaccuggcccugauggccgugcaccacgccuucagaggcaccagcagcgccuacaucgccaccaugcugagcaagaagagcaacaacgaccuggugaccuacaccaacaagaucaaggagaaguuccccggcaacgcccugcugaaggccaucauggacuacaucagcuacaugaagggccugagcgagaugaccaacuucaaguacgacgaguucugggacgaccugcugcacaagcccagccccaccaacgcccccccccugagcagagacagcgagcccagcuacaacuucaagagcgugaucagcagcagaagcgugaagagcugcaagaacgugaagaacguggugugccugagccccagaagcggcgugagcuacgacagcauccuggccugcggcgagcccaacggccccagcguguacaagaagcccagcgacggcguguuccagagcaacagcgacaagaccauguacugccuggccgacagccacugccuggaggacuucgagguggugagccaggaggagcuggacgccaucaagaagagcaagugcugggugaccgaguaccccaacgugaagcugagcaagcugagcgacggcaucaccagcugcagaaugaaggacagcggcaagugcaacguggccgccaacagauggcccaucauccagugcgagaacgacaaguucuacuacagcgagcugcagaacgacuacgacaagacccaggacaucggccacuucugccugagccccggcugcagcaccaucagauuccccaucaaccagaagcacaucagcaacugcaacuggcaggugagcagaagcagcaucgccaagaucgacgugcacgacaucgaggacaucgaccaguacagaaaggccaucacccagaagcugcagaccggccugagccuguucaaguacgccaagaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaacagcaaggagggcaagcaccugcuggacaucgugggcuacgugaagagcgccagcuacagcagcguguacaccaagcuguacagcaccggccccaccagcggcaucaacaccaagcacgacgagcugugcaccggccccugccccgugaacaucaaccaccagaccggcuggcugaccuucgccaaggagagaaccagcagcuggggcugcgaggaguucggcugccuggccaucagcgacggcugcguguucggcagcugccaggacaucgugagagacgagcugagcguguacagaaaggagaccgaggaggugaccgacguggagcugugccugaccuucagcgacaagaccuacugcaccaaccugaaccccaucacccccaucaucaccgaccuguucgaggugcaguucaagaccguggagaccuacagccugcccagaaucguggccauccagaaccacgaggugaagaucggccagaucaacgaccugggcguguacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagacccccgccagcuacagacuggaggagagcagcggcaccgugaccgugaucgacuacaagaagauccugggcaccaucaagaugaaggccauccugggcgacgugaaguacaagaccuucgccgacaacguggacaugaccgccgagggcagcugcgccggcugcaucaacugcuucgagaacauccacugcgagcugacccugcacaccaccaucgacgccagcugccccgugaccagccccugcaccguguuccacgacagaauccugaucacccccaacgagcacaaguacgccaugaaggugaucugcaccgagaagcccggcaacacccugaccaucaagaucugcggcaccaagaucgacgccagccuggcccugaucgacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucugcaucaucgugcugcugaucgugaucuacaucgugcugcccaucugcuucaagcugagagacacccugagacagcacgaggacgccuacaagagagagaugaagaucagauga
